United States Patent 11,241,493 (CORONAVIRUS VACCINE) - sequence listing, part 12

SEQ ID NO: 23943 - RNA, 4129 nt, Artificial Sequence
  SARS-CoV-2/Wuhan/WIV05/2019__EPI_ISL_402128 spike protein mRNA gc mod (1-1273)(S477N_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23944 - RNA, 4129 nt, Artificial Sequence
  SARS-CoV-2/Wuhan/WIV05/2019__EPI_ISL_402128 spike protein mRNA gc mod (1-1273)(N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23945 - RNA, 4123 nt, Artificial Sequence
  SARS-CoV-2/Wuhan/WIV05/2019__EPI_ISL_402128 spike protein mRNA gc mod (1-1273)(H69del_V70del_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23946 - RNA, 4129 nt, Artificial Sequence
  SARS-CoV-2/Wuhan/WIV05/2019__EPI_ISL_402128 spike protein mRNA gc mod (1-1273)(Y453F_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23947 - RNA, 4129 nt, Artificial Sequence
  SARS-CoV-2/Wuhan/WIV05/2019__EPI_ISL_402128 spike protein mRNA gc mod (1-1273)(D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23948 - RNA, 4129 nt, Artificial Sequence
  SARS-CoV-2/Wuhan/WIV05/2019__EPI_ISL_402128 spike protein mRNA gc mod (1-1273)(D614G_M1229I)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23949 - RNA, 4123 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23950 - RNA, 4123 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23951 - RNA, 4120 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23952 - RNA, 4129 nt, Artificial Sequence
  SARS-CoV-2/Wuhan/WIV05/2019__EPI_ISL_402128 spike protein mRNA gc mod (1-1273)(K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23953 - RNA, 4120 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23954 - RNA, 4129 nt, Artificial Sequence
  SARS-CoV-2/Wuhan/WIV05/2019__EPI_ISL_402128 spike protein mRNA gc mod (1-1273)(E484K_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23955 - RNA, 4129 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23956 - RNA, 4129 nt, Artificial Sequence
  SARS-CoV-2/Wuhan/WIV05/2019__EPI_ISL_402128 spike protein mRNA gc mod (1-1273)(S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23957 - RNA, 4129 nt, Artificial Sequence
  SARS-CoV-2/Wuhan/WIV05/2019__EPI_ISL_402128 spike protein mRNA gc (1-1273)(K986P_V987P) R10155
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23958 - RNA, 4129 nt, Artificial Sequence
  SARS-CoV-2/Wuhan/WIV05/2019__EPI_ISL_402128 spike protein mRNA gc (1-1273)(K986P_V987P_ D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23959 - RNA, 4129 nt, Artificial Sequence
  SARS-CoV-2/Wuhan/WIV05/2019__EPI_ISL_402128 spike protein mRNA gc (1-1273)(K986P_V987P_A222V_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23960 - RNA, 4129 nt, Artificial Sequence
  SARS-CoV-2/Wuhan/WIV05/2019__EPI_ISL_402128 spike protein mRNA gc (1-1273)(K986P_V987P_N439K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23961 - RNA, 4129 nt, Artificial Sequence
  SARS-CoV-2/Wuhan/WIV05/2019__EPI_ISL_402128 spike protein mRNA gc (1-1273)(K986P_V987P_S477N_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23962 - RNA, 4129 nt, Artificial Sequence
  SARS-CoV-2/Wuhan/WIV05/2019__EPI_ISL_402128 spike protein mRNA gc (1-1273)(K986P_V987P_N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23963 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23964 - RNA, 4129 nt, Artificial Sequence
  SARS-CoV-2/Wuhan/WIV05/2019__EPI_ISL_402128 spike protein mRNA gc (1-1273)(K986P_V987P_Y453F_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23965 - RNA, 4129 nt, Artificial Sequence
  SARS-CoV-2/Wuhan/WIV05/2019__EPI_ISL_402128 spike protein mRNA gc (1-1273)(K986P_V987P_D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23966 - RNA, 4129 nt, Artificial Sequence
  SARS-CoV-2/Wuhan/WIV05/2019__EPI_ISL_402128 spike protein mRNA gc (1-1273)(K986P_V987P_D614G_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23967 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23968 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23969 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23970 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23971 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23972 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23973 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23974 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23975 - RNA, 4129 nt, Artificial Sequence
  SARS-CoV-2/Wuhan/WIV05/2019__EPI_ISL_402128 spike protein mRNA gc (1-1273)(K986P_V987P)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23976 - RNA, 4129 nt, Artificial Sequence
  SARS-CoV-2/Wuhan/WIV05/2019__EPI_ISL_402128 spike protein mRNA gc (1-1273)(K986P_V987P_ D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23977 - RNA, 4129 nt, Artificial Sequence
  SARS-CoV-2/Wuhan/WIV05/2019__EPI_ISL_402128 spike protein mRNA gc (1-1273)(K986P_V987P_A222V_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23978 - RNA, 4129 nt, Artificial Sequence
  SARS-CoV-2/Wuhan/WIV05/2019__EPI_ISL_402128 spike protein mRNA gc (1-1273)(K986P_V987P_N439K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23979 - RNA, 4129 nt, Artificial Sequence
  SARS-CoV-2/Wuhan/WIV05/2019__EPI_ISL_402128 spike protein mRNA gc (1-1273)(K986P_V987P_S477N_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23980 - RNA, 4129 nt, Artificial Sequence
  SARS-CoV-2/Wuhan/WIV05/2019__EPI_ISL_402128 spike protein mRNA gc (1-1273)(K986P_V987P_N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23981 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23982 - RNA, 4129 nt, Artificial Sequence
  SARS-CoV-2/Wuhan/WIV05/2019__EPI_ISL_402128 spike protein mRNA gc (1-1273)(K986P_V987P_Y453F_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23983 - RNA, 4129 nt, Artificial Sequence
  SARS-CoV-2/Wuhan/WIV05/2019__EPI_ISL_402128 spike protein mRNA gc (1-1273)(K986P_V987P_D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23984 - RNA, 4129 nt, Artificial Sequence
  SARS-CoV-2/Wuhan/WIV05/2019__EPI_ISL_402128 spike protein mRNA gc (1-1273)(K986P_V987P_D614G_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23985 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23986 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23987 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23988 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23989 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23990 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23991 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagacccgugacccggaaguuguacggcuacgcgacuuucccucccacaaacccucgcgcccuuccuuuccuacuugggcccggcagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23992 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23993 - RNA, 4129 nt, Artificial Sequence
  SARS-CoV-2/Wuhan/WIV05/2019__EPI_ISL_402128 spike protein mRNA gc (1-1273)(K986P_V987P)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23994 - RNA, 4129 nt, Artificial Sequence
  SARS-CoV-2/Wuhan/WIV05/2019__EPI_ISL_402128 spike protein mRNA gc (1-1273)(K986P_V987P_ D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23995 - RNA, 4129 nt, Artificial Sequence
  SARS-CoV-2/Wuhan/WIV05/2019__EPI_ISL_402128 spike protein mRNA gc (1-1273)(K986P_V987P_A222V_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23996 - RNA, 4129 nt, Artificial Sequence
  SARS-CoV-2/Wuhan/WIV05/2019__EPI_ISL_402128 spike protein mRNA gc (1-1273)(K986P_V987P_N439K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23997 - RNA, 4129 nt, Artificial Sequence
  SARS-CoV-2/Wuhan/WIV05/2019__EPI_ISL_402128 spike protein mRNA gc (1-1273)(K986P_V987P_S477N_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23998 - RNA, 4129 nt, Artificial Sequence
  SARS-CoV-2/Wuhan/WIV05/2019__EPI_ISL_402128 spike protein mRNA gc (1-1273)(K986P_V987P_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 23999 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24000 - RNA, 4129 nt, Artificial Sequence
  SARS-CoV-2/Wuhan/WIV05/2019__EPI_ISL_402128 spike protein mRNA gc (1-1273)(K986P_V987P_Y453F_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24001 - RNA, 4129 nt, Artificial Sequence
  SARS-CoV-2/Wuhan/WIV05/2019__EPI_ISL_402128 spike protein mRNA gc (1-1273)(K986P_V987P_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24002 - RNA, 4129 nt, Artificial Sequence
  SARS-CoV-2/Wuhan/WIV05/2019__EPI_ISL_402128 spike protein mRNA gc (1-1273)(K986P_V987P_D614G_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24003 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24004 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24005 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24006 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24007 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24008 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24009 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24010 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24011 - RNA, 4129 nt, Artificial Sequence
  SARS-CoV-2/Wuhan/WIV05/2019__EPI_ISL_402128 spike protein mRNA gc (1-1273)(K986P_V987P)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24012 - RNA, 4129 nt, Artificial Sequence
  SARS-CoV-2/Wuhan/WIV05/2019__EPI_ISL_402128 spike protein mRNA gc (1-1273)(K986P_V987P_ D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24013 - RNA, 4129 nt, Artificial Sequence
  SARS-CoV-2/Wuhan/WIV05/2019__EPI_ISL_402128 spike protein mRNA gc (1-1273)(K986P_V987P_A222V_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24014 - RNA, 4129 nt, Artificial Sequence
  SARS-CoV-2/Wuhan/WIV05/2019__EPI_ISL_402128 spike protein mRNA gc (1-1273)(K986P_V987P_N439K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24015 - RNA, 4129 nt, Artificial Sequence
  SARS-CoV-2/Wuhan/WIV05/2019__EPI_ISL_402128 spike protein mRNA gc (1-1273)(K986P_V987P_S477N_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24016 - RNA, 4129 nt, Artificial Sequence
  SARS-CoV-2/Wuhan/WIV05/2019__EPI_ISL_402128 spike protein mRNA gc (1-1273)(K986P_V987P_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24017 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24018 - RNA, 4129 nt, Artificial Sequence
  SARS-CoV-2/Wuhan/WIV05/2019__EPI_ISL_402128 spike protein mRNA gc (1-1273)(K986P_V987P_Y453F_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24019 - RNA, 4129 nt, Artificial Sequence
  SARS-CoV-2/Wuhan/WIV05/2019__EPI_ISL_402128 spike protein mRNA gc (1-1273)(K986P_V987P_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24020 - RNA, 4129 nt, Artificial Sequence
  SARS-CoV-2/Wuhan/WIV05/2019__EPI_ISL_402128 spike protein mRNA gc (1-1273)(K986P_V987P_D614G_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24021 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24022 - RNA, 4123 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24023 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24024 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24025 - RNA, 4120 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24026 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24027 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagacccgugacccggaaguuguacggcuacgcgacuuucccucccacaaacccucgcgcccuuccuuuccuacuugggcccggcagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24028 - RNA, 4129 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24029 - RNA, 4129 nt, Artificial Sequence
  SARS-CoV-2/Wuhan/WIV05/2019__EPI_ISL_402128 spike protein mRNA gc mod (1-1273)(K986P_V987P)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24030 - RNA, 4129 nt, Artificial Sequence
  SARS-CoV-2/Wuhan/WIV05/2019__EPI_ISL_402128 spike protein mRNA gc mod (1-1273)(K986P_V987P_ D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24031 - RNA, 4129 nt, Artificial Sequence
  SARS-CoV-2/Wuhan/WIV05/2019__EPI_ISL_402128 spike protein mRNA gc mod (1-1273)(K986P_V987P_A222V_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24032 - RNA, 4129 nt, Artificial Sequence
  SARS-CoV-2/Wuhan/WIV05/2019__EPI_ISL_402128 spike protein mRNA gc mod (1-1273)(K986P_V987P_N439K_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24033 - RNA, 4129 nt, Artificial Sequence
  SARS-CoV-2/Wuhan/WIV05/2019__EPI_ISL_402128 spike protein mRNA gc mod (1-1273)(K986P_V987P_S477N_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24034 - RNA, 4129 nt, Artificial Sequence
  SARS-CoV-2/Wuhan/WIV05/2019__EPI_ISL_402128 spike protein mRNA gc mod (1-1273)(K986P_V987P_N501Y_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24035 - RNA, 4123 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24036 - RNA, 4129 nt, Artificial Sequence
  SARS-CoV-2/Wuhan/WIV05/2019__EPI_ISL_402128 spike protein mRNA gc mod (1-1273)(K986P_V987P_Y453F_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24037 - RNA, 4129 nt, Artificial Sequence
  SARS-CoV-2/Wuhan/WIV05/2019__EPI_ISL_402128 spike protein mRNA gc mod (1-1273)(K986P_V987P_D614G_I692V)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24038 - RNA, 4129 nt, Artificial Sequence
  SARS-CoV-2/Wuhan/WIV05/2019__EPI_ISL_402128 spike protein mRNA gc mod (1-1273)(K986P_V987P_D614G_M1229I)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24039 - RNA, 4123 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24040 - RNA, 4123 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24041 - RNA, 4120 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24042 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24043 - RNA, 4120 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24044 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24045 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagacccgugacccggaaguuguacggcuacgcgacuuucccucccacaaacccucgcgcccuuccuuuccuacuugggcccggcagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24046 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagacccgugacccggaaguuguacggcuacgcgacuuucccucccacaaacccucgcgcccuuccuuuccuacuugggcccggcagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24047 - RNA, 4129 nt, Artificial Sequence
  SARS-CoV-2/Wuhan/WIV05/2019__EPI_ISL_402128 spike protein mRNA gc mod (1-1273)(K986P_V987P)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24048 - RNA, 4129 nt, Artificial Sequence
  SARS-CoV-2/Wuhan/WIV05/2019__EPI_ISL_402128 spike protein mRNA gc mod (1-1273)(K986P_V987P_ D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24049 - RNA, 4129 nt, Artificial Sequence
  SARS-CoV-2/Wuhan/WIV05/2019__EPI_ISL_402128 spike protein mRNA gc mod (1-1273)(K986P_V987P_A222V_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24050 - RNA, 4129 nt, Artificial Sequence
  SARS-CoV-2/Wuhan/WIV05/2019__EPI_ISL_402128 spike protein mRNA gc mod (1-1273)(K986P_V987P_N439K_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24051 - RNA, 4129 nt, Artificial Sequence
  SARS-CoV-2/Wuhan/WIV05/2019__EPI_ISL_402128 spike protein mRNA gc mod (1-1273)(K986P_V987P_S477N_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24052 - RNA, 4129 nt, Artificial Sequence
  SARS-CoV-2/Wuhan/WIV05/2019__EPI_ISL_402128 spike protein mRNA gc mod (1-1273)(K986P_V987P_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24053 - RNA, 4123 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24054 - RNA, 4129 nt, Artificial Sequence
  SARS-CoV-2/Wuhan/WIV05/2019__EPI_ISL_402128 spike protein mRNA gc mod (1-1273)(K986P_V987P_Y453F_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24055 - RNA, 4129 nt, Artificial Sequence
  SARS-CoV-2/Wuhan/WIV05/2019__EPI_ISL_402128 spike protein mRNA gc mod (1-1273)(K986P_V987P_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24056 - RNA, 4129 nt, Artificial Sequence
  SARS-CoV-2/Wuhan/WIV05/2019__EPI_ISL_402128 spike protein mRNA gc mod (1-1273)(K986P_V987P_D614G_M1229I)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24057 - RNA, 4123 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24058 - RNA, 4123 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24059 - RNA, 4120 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24060 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24061 - RNA, 4120 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24062 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24063 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagacccgugacccggaaguuguacggcuacgcgacuuucccucccacaaacccucgcgcccuuccuuuccuacuugggcccggcagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24064 - RNA, 4129 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagacccgugacccggaaguuguacggcuacgcgacuuucccucccacaaacccucgcgcccuuccuuuccuacuugggcccggcagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguguccaccugucccuccugggcugcuggauugucucguuuuccugccaaauaaacaggaucagcgcuuuacagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24065 - RNA, 1365 nt, Artificial Sequence
  SARS-CoV-2/Wuhan/WIV05/2019__EPI_ISL_402128 spike protein mRNA gc (1-15,334-528) Ferritin construct
aggagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggggguggaagcggcggggguggaagugacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24066 - RNA, 963 nt, Artificial Sequence
  SARS-CoV-2/Wuhan/WIV05/2019__EPI_ISL_402128 spike protein mRNA gc (334-528) Foldon construct
aggagaaagcuuaccaugcccaugggcagccugcagccgcucgccacccuguaccugcucgggaugcugguggccuccguccuggcgaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcagcggcggguacauccccgaggccccgcgcgacggccaggccuacgugcggaaggacggcgaguggguccugcugagcaccuuccucugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24067 - RNA, 1341 nt, Artificial Sequence
  SARS-CoV-2/Wuhan/WIV05/2019__EPI_ISL_402128 spike protein mRNA gc (1-15,334-528) LumSynth construct
aggagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggcggcggcuccggaggcggagguagcgggggacagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24068 - RNA, 1302 nt, Artificial Sequence
  SARS-CoV-2/Wuhan/WIV05/2019__EPI_ISL_402128 spike protein mRNA gc (334-528) LumSynth construct
aggagaaagcuuaccaugcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcggcgggggcgggagcggcgggggcggcuccgggggcgggaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24069 - RNA, 4035 nt, Artificial Sequence
  SARS-CoV-2/Wuhan/WIV05/2019__EPI_ISL_402128 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24070 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24071 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24072 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24073 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24074 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24075 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24076 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24077 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24078 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24079 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24080 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24081 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24082 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24083 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24084 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24085 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24086 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24087 - RNA, 4035 nt, Artificial Sequence; identical to SEQ ID NO: 24069
  SARS-CoV-2/Wuhan/WIV05/2019__EPI_ISL_402128 spike protein mRNA gc (1-1273)

SEQ ID NO: 24088 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24089 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24090 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24091 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24092 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24093 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24094 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24095 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24096 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24097 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24098 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24099 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24100 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24101 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24102 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24103 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24104 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24105 - RNA, 4035 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24106 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24107 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24108 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24109 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24110 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24111 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24112 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24113 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24114 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24115 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24116 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24117 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24118 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24119 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24120 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24121 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24122 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24123 - RNA, 4035 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24124 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24125 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24126 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24127 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24128 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24129 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24130 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24131 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24132 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24133 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24134 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24135 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24136 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24137 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24138 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24139 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24140 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24141 - RNA, 4035 nt, Artificial Sequence
  SARS-CoV-2/Wuhan/WIV05/2019__EPI_ISL_402128 spike protein mRNA gc mod (1-1273)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24142 - RNA, 4035 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24143 - RNA, 4035 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24144 - RNA, 4035 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24145 - RNA, 4035 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24146 - RNA, 4035 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24147 - RNA, 4029 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24148 - RNA, 4035 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24149 - RNA, 4035 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24150 - RNA, 4035 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24151 - RNA, 4029 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24152 - RNA, 4029 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24153 - RNA, 4026 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24154 - RNA, 4035 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24155 - RNA, 4026 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24156 - RNA, 4035 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24157 - RNA, 4035 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24158 - RNA, 4035 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24159 - RNA, 4035 nt, Artificial Sequence
  SARS-CoV-2/Wuhan/WIV05/2019__EPI_ISL_402128 spike protein mRNA gc mod (1-1273)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24160 - RNA, 4035 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24161 - RNA, 4035 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24162 - RNA, 4035 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24163 - RNA, 4035 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24164 - RNA, 4035 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24165 - RNA, 4029 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24166 - RNA, 4035 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24167 - RNA, 4035 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24168 - RNA, 4035 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24169 - RNA, 4029 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24170 - RNA, 4029 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24171 - RNA, 4026 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24172 - RNA, 4035 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24173 - RNA, 4026 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24174 - RNA, 4035 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24175 - RNA, 4035 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24176 - RNA, 4035 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24177 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24178 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24179 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24180 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24181 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24182 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24183 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24184 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24185 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24186 - RNA, 4035 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24187 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24188 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24189 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24190 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24191 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24192 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24193 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24194 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24195 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24196 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24197 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24198 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24199 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24200 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24201 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24202 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24203 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24204 - RNA, 4035 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24205 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24206 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24207 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24208 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24209 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24210 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24211 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24212 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24213 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24214 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24215 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24216 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24217 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24218 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24219 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24220 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24221 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24222 - RNA, 4035 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24223 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24224 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24225 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24226 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24227 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24228 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24229 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24230 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24231 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24232 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24233 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24234 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24235 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24236 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24237 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24238 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24239 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24240 - RNA, 4035 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24241 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24242 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24243 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24244 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24245 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24246 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24247 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24248 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24249 - RNA, 4035 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24250 - RNA, 4035 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24251 - RNA, 4035 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24252 - RNA, 4035 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24253 - RNA, 4035 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24254 - RNA, 4035 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24255 - RNA, 4029 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24256 - RNA, 4035 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24257 - RNA, 4035 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24258 - RNA, 4035 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24259 - RNA, 4029 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24260 - RNA, 4029 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24261 - RNA, 4026 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24262 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24263 - RNA, 4026 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24264 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24265 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24266 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24267 - RNA, 4035 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24268 - RNA, 4035 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24269 - RNA, 4035 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24270 - RNA, 4035 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24271 - RNA, 4035 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24272 - RNA, 4035 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24273 - RNA, 4029 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24274 - RNA, 4035 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24275 - RNA, 4035 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24276 - RNA, 4035 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24277 - RNA, 4029 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24278 - RNA, 4029 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24279 - RNA, 4026 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24280 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24281 - RNA, 4026 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24282 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24283 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24284 - RNA, 4035 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaaucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24285 - RNA, 1371 nt, Artificial Sequence
  SARS-CoV-2/Wuhan/WIV05/2019__EPI_ISL_402128 spike protein mRNA gc (1-15,334-528) Ferritin construct
aggagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggggguggaagcggcggggguggaagugacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24286 - RNA, 969 nt, Artificial Sequence
  SARS-CoV-2/Wuhan/WIV05/2019__EPI_ISL_402128 spike protein mRNA gc (334-528) Foldon construct
aggagaaagcuuaccaugcccaugggcagccugcagccgcucgccacccuguaccugcucgggaugcugguggccuccguccuggcgaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcagcggcggguacauccccgaggccccgcgcgacggccaggccuacgugcggaaggacggcgaguggguccugcugagcaccuuccucugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24287 - RNA, 1347 nt, Artificial Sequence
  SARS-CoV-2/Wuhan/WIV05/2019__EPI_ISL_402128 spike protein mRNA gc (1-15,334-528) LumSynth construct
aggagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggcggcggcuccggaggcggagguagcgggggacagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24288 - RNA, 1308 nt, Artificial Sequence
  SARS-CoV-2/Wuhan/WIV05/2019__EPI_ISL_402128 spike protein mRNA gc (334-528) LumSynth construct
aggagaaagcuuaccaugcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcggcgggggcgggagcggcgggggcggcuccgggggcgggaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24289 - RNA, 4041 nt, Artificial Sequence
  SARS-CoV-2/Wuhan/WIV05/2019__EPI_ISL_402128 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24290 - RNA, 4041 nt, Artificial Sequence
  SARS-CoV-2/Wuhan/WIV05/2019__EPI_ISL_402128 spike protein mRNA gc (1-1273)(D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24291 - RNA, 4041 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24292 - RNA, 4041 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24293 - RNA, 4041 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24294 - RNA, 4041 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24295 - RNA, 4035 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24296 - RNA, 4041 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24297 - RNA, 4041 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24298 - RNA, 4041 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24299 - RNA, 4035 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24300 - RNA, 4035 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24301 - RNA, 4032 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24302 - RNA, 4041 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24303 - RNA, 4032 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24304 - RNA, 4041 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24305 - RNA, 4041 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24306 - RNA, 4041 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24307 - RNA, 4041 nt, Artificial Sequence; identical to SEQ ID NO: 24289
  SARS-CoV-2/Wuhan/WIV05/2019__EPI_ISL_402128 spike protein mRNA gc (1-1273)

SEQ ID NO: 24308 - RNA, 4041 nt, Artificial Sequence
  SARS-CoV-2/Wuhan/WIV05/2019__EPI_ISL_402128 spike protein mRNA gc (1-1273)(D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24309 - RNA, 4041 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24310 - RNA, 4041 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24311 - RNA, 4041 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24312 - RNA, 4041 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24313 - RNA, 4035 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24314 - RNA, 4041 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24315 - RNA, 4041 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24316 - RNA, 4041 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24317 - RNA, 4035 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24318 - RNA, 4035 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24319 - RNA, 4032 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24320 - RNA, 4041 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24321 - RNA, 4032 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24322 - RNA, 4041 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24323 - RNA, 4041 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24324 - RNA, 4041 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24325 - RNA, 4041 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24326 - RNA, 4041 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24327 - RNA, 4041 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24328 - RNA, 4041 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24329 - RNA, 4041 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24330 - RNA, 4041 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24331 - RNA, 4035 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24332 - RNA, 4041 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24333 - RNA, 4041 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24334 - RNA, 4041 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24335 - RNA, 4035 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24336 - RNA, 4035 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24337 - RNA, 4032 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24338 - RNA, 4041 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24339 - RNA, 4032 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24340 - RNA, 4041 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24341 - RNA, 4041 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24342 - RNA, 4041 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24343 - RNA, 4041 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24344 - RNA, 4041 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24345 - RNA, 4041 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24346 - RNA, 4041 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24347 - RNA, 4041 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24348 - RNA, 4041 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24349 - RNA, 4035 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24350 - RNA, 4041 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24351 - RNA, 4041 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24352 - RNA, 4041 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24353 - RNA, 4035 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24354 - RNA, 4035 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24355 - RNA, 4032 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24356 - RNA, 4041 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24357 - RNA, 4032 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24358 - RNA, 4041 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24359 - RNA, 4041 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24360 - RNA, 4041 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24361 - RNA, 4041 nt, Artificial Sequence
  SARS-CoV-2/Wuhan/WIV05/2019__EPI_ISL_402128 spike protein mRNA gc mod (1-1273)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24362 - RNA, 4041 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24363 - RNA, 4041 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24364 - RNA, 4041 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24365 - RNA, 4041 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24366 - RNA, 4041 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24367 - RNA, 4035 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24368 - RNA, 4041 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24369 - RNA, 4041 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24370 - RNA, 4041 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24371 - RNA, 4035 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24372 - RNA, 4035 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24373 - RNA, 4032 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24374 - RNA, 4041 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24375 - RNA, 4032 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24376 - RNA, 4041 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24377 - RNA, 4041 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24378 - RNA, 4041 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24379 - RNA, 4041 nt, Artificial Sequence
  SARS-CoV-2/Wuhan/WIV05/2019__EPI_ISL_402128 spike protein mRNA gc mod (1-1273)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24380 - RNA, 4041 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24381 - RNA, 4041 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24382 - RNA, 4041 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24383 - RNA, 4041 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24384 - RNA, 4041 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24385 - RNA, 4035 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24386 - RNA, 4041 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24387 - RNA, 4041 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24388 - RNA, 4041 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24389 - RNA, 4035 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24390 - RNA, 4035 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24391 - RNA, 4032 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24392 - RNA, 4041 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24393 - RNA, 4032 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24394 - RNA, 4041 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24395 - RNA, 4041 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24396 - RNA, 4041 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24397 - RNA, 4041 nt, Artificial Sequence
  SARS-CoV-2/Wuhan/WIV05/2019__EPI_ISL_402128 spike protein mRNA gc (1-1273)(K986P_V987P) R10136, R10158
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24398 - RNA, 4041 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24399 - RNA, 4041 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24400 - RNA, 4041 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24401 - RNA, 4041 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24402 - RNA, 4041 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24403 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24404 - RNA, 4041 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24405 - RNA, 4041 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24406 - RNA, 4041 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24407 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24408 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24409 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24410 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24411 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24412 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24413 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24414 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24415 - RNA, 4041 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24416 - RNA, 4041 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24417 - RNA, 4041 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24418 - RNA, 4041 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24419 - RNA, 4041 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24420 - RNA, 4041 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24421 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24422 - RNA, 4041 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24423 - RNA, 4041 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24424 - RNA, 4041 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24425 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24426 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24427 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24428 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24429 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24430 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24431 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24432 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24433 - RNA, 4041 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24434 - RNA, 4041 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24435 - RNA, 4041 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24436 - RNA, 4041 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24437 - RNA, 4041 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24438 - RNA, 4041 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24439 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24440 - RNA, 4041 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24441 - RNA, 4041 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24442 - RNA, 4041 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24443 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24444 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24445 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24446 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24447 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24448 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24449 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24450 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24451 - RNA, 4041 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggcguguucgugagcaacggaacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24452 - RNA, 4041 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24453 - RNA, 4041 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24454 - RNA, 4041 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24455 - RNA, 4041 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24456 - RNA, 4041 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggaucccccagaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24457 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacgugcccgcccaggagaagaacuucaccaccgcccccgccauuugccacgacggcaaggcccacuucccccgggagggagucuucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24458 - RNA, 4041 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24459 - RNA, 4041 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24460 - RNA, 4041 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24461 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggaucccccagaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgcuccccacggcgugguguuccuccacgucacauacgugcccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24462 - RNA, 4035 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgcuccccacggcgugguguuccuccacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagauuaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24463 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacccacccgaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgugcccgcccaggagaagaacuucacaaccgcccccgccaucugccacgacggcaaggcccacuucccccgggagggagucuucgugagcaacggcacccacugguucgugacccagcggaacuucuacgagccccagaucaucaccacccacaacaccuucgugagcggcaacugcgacguggugaucggcaucgugaacaacaccguguacgacccucugcagcccgagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24464 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24465 - RNA, 4032 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggaucccccagaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgcuccccacggcgugguguuccugcacgucacauacgugcccgcccaggagaagaacuucaccaccgcccccgccaucugccacgacggaaaggcccacuucccccgggagggcguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcucgacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24466 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggaucccccagaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgcuccccacggcgugguguuccuccacgugacauacguccccgcccaggagaagaacuucaccaccgcccccgccauuugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccugcagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24467 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacccacccgaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgugaccuacguccccgcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccucuccagcccgagcuggacagcuucaaggaggagcuggacaaguacuucaagaaccacaccagccccgacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggccaugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24468 - RNA, 4041 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggaucccccagaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgcuccccacggcgugguguuccugcacgugacauacguccccgcccaggagaagaacuucaccaccgcccccgccaucugccacgacggcaaggcccacuucccccgggagggaguguucgugagcaacggcacccacugguucgugacccagcggaacuucuacgagccucagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccagacguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24469 - RNA, 4041 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24470 - RNA, 4041 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24471 - RNA, 4041 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24472 - RNA, 4041 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24473 - RNA, 4041 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24474 - RNA, 4041 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24475 - RNA, 4035 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24476 - RNA, 4041 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24477 - RNA, 4041 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24478 - RNA, 4041 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24479 - RNA, 4035 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24480 - RNA, 4035 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24481 - RNA, 4032 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24482 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24483 - RNA, 4032 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24484 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24485 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24486 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24487 - RNA, 4041 nt, Artificial Sequence
  SARS-CoV-2/Wuhan/WIV05/2019__EPI_ISL_402128 spike protein mRNA gc mod (1-1273)(K986P_V987P)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24488 - RNA, 4041 nt, Artificial Sequence
  SARS-CoV-2/Wuhan/WIV05/2019__EPI_ISL_402128 spike protein mRNA gc mod (1-1273)(K986P_V987P_ D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24489 - RNA, 4041 nt, Artificial Sequence
  SARS-CoV-2/Wuhan/WIV05/2019__EPI_ISL_402128 spike protein mRNA gc mod (1-1273)(K986P_V987P_A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24490 - RNA, 4041 nt, Artificial Sequence
  SARS-CoV-2/Wuhan/WIV05/2019__EPI_ISL_402128 spike protein mRNA gc mod (1-1273)(K986P_V987P_N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24491 - RNA, 4041 nt, Artificial Sequence
  SARS-CoV-2/Wuhan/WIV05/2019__EPI_ISL_402128 spike protein mRNA gc mod (1-1273)(K986P_V987P_S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24492 - RNA, 4041 nt, Artificial Sequence
  SARS-CoV-2/Wuhan/WIV05/2019__EPI_ISL_402128 spike protein mRNA gc mod (1-1273)(K986P_V987P_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24493 - RNA, 4035 nt, Artificial Sequence
  SARS-CoV-2/Wuhan/WIV05/2019__EPI_ISL_402128 spike protein mRNA gc mod (1-1273)(K986P_V987P_H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24494 - RNA, 4041 nt, Artificial Sequence
  SARS-CoV-2/Wuhan/WIV05/2019__EPI_ISL_402128 spike protein mRNA gc mod (1-1273)(K986P_V987P_Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24495 - RNA, 4041 nt, Artificial Sequence
  SARS-CoV-2/Wuhan/WIV05/2019__EPI_ISL_402128 spike protein mRNA gc mod (1-1273)(K986P_V987P_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24496 - RNA, 4041 nt, Artificial Sequence
  SARS-CoV-2/Wuhan/WIV05/2019__EPI_ISL_402128 spike protein mRNA gc mod (1-1273)(K986P_V987P_D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24497 - RNA, 4035 nt, Artificial Sequence
  SARS-CoV-2/Wuhan/WIV05/2019__EPI_ISL_402128 spike protein mRNA gc mod (1-1273)(K986P_V987P_H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24498 - RNA, 4035 nt, Artificial Sequence
  SARS-CoV-2/Wuhan/WIV05/2019__EPI_ISL_402128 spike protein mRNA gc mod (1-1273)(K986P_V987P_H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24499 - RNA, 4032 nt, Artificial Sequence
  SARS-CoV-2/Wuhan/WIV05/2019__EPI_ISL_402128 spike protein mRNA gc mod (1-1273)(K986P_V987P_K986P_V987P_H69del_V70del_Y144del_N501Y_A570 D_D614G_P681H_T716I_S982A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24500 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24501 - RNA, 4032 nt, Artificial Sequence
  SARS-CoV-2/Wuhan/WIV05/2019__EPI_ISL_402128 spike protein mRNA gc mod (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24502 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24503 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24504 - RNA, 4041 nt, Artificial Sequence
  SARS-CoV-2/Wuhan/WIV05/2019__EPI_ISL_402128 spike protein mRNA gc mod (1-1273)(K986P_V987P_K986P_V987P_S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacccuccugaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagauuaauagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24505 - RNA, 1365 nt, Artificial Sequence
  SARS-CoV-2/Wuhan/WIV05/2019__EPI_ISL_402128 spike protein mRNA gc (1-15,334-528) Ferritin construct
aggagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggggguggaagcggcggggguggaagugacaucaucaagcuccugaacgagcaggucaacaaggagaugcaguccagcaaccuguacauguccaugagcuccuggugcuacacccacagccucgacggcgccgggcuguuccuguucgaccacgccgcggaggaguacgagcacgccaagaagcucaucaucuuccugaacgagaacaacgugcccgugcagcugaccuccaucagcgccccggagcacaaguucgagggccucacgcagaucuuccagaaggccuacgagcacgagcagcacaucuccgagagcaucaacaacaucguggaccacgccaucaaguccaaggaccacgcgaccuucaacuuccugcagugguacgucgccgagcagcacgaggaggaggugcuguucaaggacauccucgacaagaucgagcugaucgggaacgagaaccacggccuguaccucgccgaccaguacgugaaggggaucgccaagagccgcaaguccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24506 - RNA, 963 nt, Artificial Sequence
  SARS-CoV-2/Wuhan/WIV05/2019__EPI_ISL_402128 spike protein mRNA gc (334-528) Foldon construct
aggagaaagcuuaccaugcccaugggcagccugcagccgcucgccacccuguaccugcucgggaugcugguggccuccguccuggcgaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcagcggcggguacauccccgaggccccgcgcgacggccaggccuacgugcggaaggacggcgaguggguccugcugagcaccuuccucugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24507 - RNA, 1341 nt, Artificial Sequence
  SARS-CoV-2/Wuhan/WIV05/2019__EPI_ISL_402128 spike protein mRNA gc (1-15,334-528) LumSynth construct
aggagaaagcuuaccauguucguguuccugguccuccugccccuggugagcucccagugcaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagggcggcggcggcuccggaggcggagguagcgggggacagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24508 - RNA, 1302 nt, Artificial Sequence
  SARS-CoV-2/Wuhan/WIV05/2019__EPI_ISL_402128 spike protein mRNA gc (334-528) LumSynth construct
aggagaaagcuuaccaugcagaucuacgagggcaagcugaccgccgaggggcuccgcuucggcaucguggccagccgguucaaccacgcgcuggucgaccgccugguggagggggccaucgacgccaucgugcggcacggcgggcgcgaggaggacaucacccucguccgggugcccggcuccugggagaucccgguggccgccggcgagcuggcccgcaaggaggacaucgacgcggucaucgccaucggggugcugauccggggcgccacgccccacuucgacuacaucgccagcgagguguccaaggggcucgcggaccugagccuggagcuccgcaagcccaucaccuucggcgucaucaccgccgacacccuggagcaggccaucgagcgggccgggacgaagcacggcaacaagggcugggaggccgcgcuguccgccaucgagauggccaaccucuucaagagccugcgcggcgggggcgggagcggcgggggcggcuccgggggcgggaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24509 - RNA, 4035 nt, Artificial Sequence
  SARS-CoV-2/Wuhan/WIV05/2019__EPI_ISL_402128 spike protein mRNA gc (1-1273)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24510 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24511 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24512 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24513 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24514 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24515 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24516 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24517 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24518 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24519 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24520 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24521 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24522 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24523 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24524 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24525 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24526 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacaaggucgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24527 - RNA, 4035 nt, Artificial Sequence; identical to SEQ ID NO: 24509
  SARS-CoV-2/Wuhan/WIV05/2019__EPI_ISL_402128 spike protein mRNA gc (1-1273)

SEQ ID NO: 24528 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24529 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggccgcggagauccgcgccagcgccaaccucgccgccaccaagauguccgagugcgugcugggccagagcaagcggguggacuucugcgggaagggcuaccaccugauguccuucccccagagcgcgccgcacggggucguguuccuccacgucacguacgugcccgcccaggagaagaacuucaccaccgcccccgccaucugccacgacggcaaggcgcacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgccaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24530 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24531 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacaaggucgaggccgaggugcagaucgaccggcugaucaccggccgccuccagucccugcagaccuacgugacccagcagcugauccgggcggccgagauccgcgccagcgccaaccucgccgcgaccaagaugagcgagugcguccugggccaguccaagcggguggacuucugcgggaagggcuaccaccugaugagcuucccccaguccgccccgcacgggguggucuuccuccacgugacguacguccccgcccaggagaagaacuucaccaccgcccccgcgaucugccacgacggcaaggcccacuucccccgcgaggggguguucgugagcaacggcacccacugguucgucacgcagcggaacuucuacgagccgcagaucaucaccaccgacaacaccuucguguccggcaacugcgacguggucaucgggaucgugaacaacacgguguacgacccccugcagcccgagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggccgugguacaucuggcugggcuucaucgccgggcugaucgcgaucgugauggugaccaucaugcucugcugcaugaccuccugcugcagcugccugaagggcugcugcuccugcgggagcugcugcaaguucgacgaggacgacuccgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24532 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24533 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacaagguggaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgccccgcacggggugguguuccuccacgucacguacgugcccgcccaggagaagaacuucaccaccgcccccgcgaucugccacgacggcaaggcccacuucccccgcgagggggucuucguguccaacggcacccacugguucgugacgcagcggaacuucuacgagccgcagaucaucaccaccgacaacaccuucgucagcggcaacugcgacguggugaucgggaucgucaacaacacgguguacgacccccugcagcccgagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagcccgugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24534 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24535 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacaagguggaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgccccgcacggggucguguuccuccacgucacguacgugcccgcccaggagaagaacuucaccaccgcccccgcgaucugccacgacggcaaggcccacuucccccgcgaggggguguucgucuccaacggcacccacugguucgugacgcagcggaacuucuacgagccgcagaucaucaccaccgacaacaccuucgugagcggcaacugcgacgucgugaucgggaucgugaacaacacggucuacgacccccugcagcccgagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggccgugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagcccgugcugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24536 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24537 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacaagguggaggccgaggugcagaucgaccggcugaucaccggccgccuccagucccugcagaccuacgucacccagcagcugauccgggccgcggagauccgcgccagcgccaaccucgccgccaccaagaugagcgagugcgugcugggccaguccaagcggguggacuucugcgggaagggcuaccaccugaugagcuucccccaguccgcgccgcacggggucguguuccuccacgucacguacgugcccgcccaggagaagaacuucaccaccgcccccgccaucugccacgacggcaaggcgcacuucccccgcgaggggguguucgucagcaacggcacccacugguucgugacgcagcggaacuucuacgagccgcagaucaucaccaccgacaacaccuucguguccggcaacugcgacgucgugaucgggaucgugaacaacacggucuacgacccccugcagcccgagcuggacagcuucaaggaggagcucgacaaguacuucaagaaccacaccucccccgacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggccgugguacaucuggcugggcuucaucgccgggcugaucgccaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24538 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugaucgugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24539 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacaagguggaggccgagguccagaucgaccggcugaucacgggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucaccuacgugccggcccaggagaagaacuucacgaccgcccccgccaucugccacgacggcaaggcccacuucccccgcgagggggucuucgugagcaacggcacccacugguucgugacccagcggaacuucuacgagccccagaucaucacgacccacaacaccuucgucuccggcaacugcgacguggugaucgggaucgucaacaacaccguguacgacccgcugcagcccgagcuggacagcuucaaggaggagcucgacaaguacuucaagaaccacacgucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24540 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24541 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacaagguggaggccgaggugcagaucgaccgccugaucaccggccggcuccagagccugcagaccuacgucacccagcagcugauccgcgccgcggagauccgggccagcgccaaccucgccgccaccaagauguccgagugcgugcuggggcagagcaagcgcguggacuucugcggcaagggguaccaccugauguccuucccccagagcgcgccgcacggcgucguguuccuccacgucacguacgugcccgcccaggagaagaacuucaccaccgcccccgccaucugccacgacgggaaggcgcacuucccccgggagggcguguucgucuccaacggcacccacugguucgugacgcagcgcaacuucuacgagccgcagaucaucaccaccgacaacaccuucgugagcgggaacugcgacgucgugaucggcaucgugaacaacacggucuacgacccccugcagcccgagcuggacuccuucaaggaggagcucgacaaguacuucaagaaccacaccagccccgacguggaccugggggacaucuccggcaucaacgccagcguggucaacauccagaaggagaucgaccggcugaacgagguggccaagaaccucaacgagucccugaucgaccugcaggagcucggcaaguacgagcaguacaucaaguggccgugguacaucuggcugggguucaucgccggccugaucgccaucgugauggucaccaucaugcucugcugcaugaccagcugcugcuccugccugaaggggugcugcagcugcggcuccugcugcaaguucgacgaggacgacagcgagcccgugcugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24542 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacaaggucgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgccccgcacgggguggucuuccuccacgugacguacguccccgcccaggagaagaacuucaccaccgcccccgcgaucugccacgacggcaaggcccacuucccccgcgaggggguguucguguccaacggcacccacugguucgucacgcagcggaacuucuacgagccgcagaucaucaccaccgacaacaccuucgugagcggcaacugcgacguggucaucgggaucgugaacaacacgguguacgacccccugcagcccgagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggccgugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagcccguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24543 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaucaagauguccgagugcguccucggccagagcaagcgcguggacuucugcgggaagggcuaccaccugauguccuucccccagagcgcgccccacgggguggucuuccugcacgugaccuacgucccggcccaggagaagaacuucacgaccgcccccgccaucugccacgacggcaaggcccacuucccccgggaggggguguucguguccaacggcacccacugguucgucacccagcgcaacuucuacgagccccagaucaucacgaccgacaacaccuucgugagcggcaacugcgacguggucaucgggaucgugaacaacaccguguacgacccgcuccagcccgagcuggacuccuucaaggaggagcuggacaaguacuucaagaaccacacgagccccgacgucgaccucggcgacaucuccgggaucaacgccagcguggugaacauccagaaggagaucgaccggcugaacgaggucgccaagaaccugaacgagucccucaucgaccugcaggagcugggcaaguacgagcaguacaucaaguggcccugguacaucuggcucggcuucaucgccgggcugaucgcgaucgugauggugaccaucaugcugugcugcaugaccagcugcugcuccugccucaagggcugcugcagcugcggguccugcugcaaguucgacgaggacgacagcgagccgguccugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24544 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacaaggucgaggccgaggugcagaucgaccgccugaucaccggccggcugcagucccuccagaccuacgugacccagcagcugauccgcgcggccgagauccgggccagcgccaaccuggccgcgaccaagaugagcgagugcguccucggccaguccaagcgcguggacuucugcgggaagggcuaccaccugaugagcuucccccaguccgccccgcacgggguggucuuccugcacgugacguacguccccgcccaggagaagaacuucaccaccgcccccgcgaucugccacgacggcaaggcccacuucccccgggaggggguguucgugagcaacggcacccacugguucgucacgcagcgcaacuucuacgagccgcagaucaucaccaccgacaacaccuucguguccggcaacugcgacguggucaucgggaucgugaacaacacgguguacgacccccuccagcccgagcuggacagcuucaaggaggagcuggacaaguacuucaagaaccacaccucccccgacgucgaccucggcgacaucagcgggaucaacgccuccguggugaacauccagaaggagaucgaccggcugaacgaggucgccaagaaccugaacgagagccucaucgaccugcaggagcugggcaaguacgagcaguacaucaaguggccgugguacaucuggcucggcuucaucgccgggcugaucgcgaucgugauggugaccaucaugcugugcugcaugaccuccugcugcagcugccucaagggcugcugcuccugcgggagcugcugcaaguucgacgaggacgacuccgagcccguccugaagggcgugaagcugcacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24545 - RNA, 4035 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24546 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24547 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24548 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24549 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24550 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24551 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24552 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24553 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24554 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24555 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24556 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24557 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgacgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucacaccggagggcaaggagcguggccagccagagcaucaucgccuacaccaugagccugggcgccgagaacagcguggccuacagcaacaacagcaucgccauccccaucaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccuggcccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccacccacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24558 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24559 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgccaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcggggccugccccagggcuucucagcccuggagccccugguggaccugcccaucggcaucaacaucacccgguuccagacccugcacaucagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaacaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcguggagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24560 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24561 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugccaagcgccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacuaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugagcgaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaccaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcgugaagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgaguacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaucaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24562 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcugcauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccgcuaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacaaggucgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24563 - RNA, 4035 nt, Artificial Sequence
  SARS-CoV-2/Wuhan/WIV05/2019__EPI_ISL_402128 spike protein mRNA gc (1-1273)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccaggacgugaacugcaccgaggugcccguggccauccacgccgaccagcugacccccaccuggcggguguacagcaccggaagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgauugccugggcgacaucgccgcucgggaccugaucugcgcccagaaguucaacgggcugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggcguguucgugagcaacggaacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgauguggaccugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24564 - RNA, 4035 nt, Artificial Sequence
  SARS-CoV-2/Wuhan/WIV05/2019__EPI_ISL_402128 spike protein mRNA gc (1-1273)(D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24565 - RNA, 4035 nt, Artificial Sequence
  SARS-CoV-2/Wuhan/WIV05/2019__EPI_ISL_402128 spike protein mRNA gc (1-1273)(A222V_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgucagcgugaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagcccccggcgggcccggagcguggccagccagagcaucaucgccuacaccaugagcuuaggcgccgagaacagcguggccuacagcaacaacagcaucgccaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccauuugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24566 - RNA, 4035 nt, Artificial Sequence
  SARS-CoV-2/Wuhan/WIV05/2019__EPI_ISL_402128 spike protein mRNA gc (1-1273)(N439K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaagaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24567 - RNA, 4035 nt, Artificial Sequence
  SARS-CoV-2/Wuhan/WIV05/2019__EPI_ISL_402128 spike protein mRNA gc (1-1273)(S477N_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcaacacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugcgccuccuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaauuucggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24568 - RNA, 4035 nt, Artificial Sequence
  SARS-CoV-2/Wuhan/WIV05/2019__EPI_ISL_402128 spike protein mRNA gc (1-1273)(N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaacgacauccugagcaggcuggacaagguggaggccgaggugcagaucgaccggcugaucaccggccggcugcagagccugcagaccuacgugacccagcagcugauccgggccgccgagauccgggccagcgccaaucuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24569 - RNA, 4029 nt, Artificial Sequence
  SARS-CoV-2/Wuhan/WIV05/2019__EPI_ISL_402128 spike protein mRNA gc (1-1273)(H69del_V70del_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgugacauacguccccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24570 - RNA, 4035 nt, Artificial Sequence
  SARS-CoV-2/Wuhan/WIV05/2019__EPI_ISL_402128 spike protein mRNA gc (1-1273)(Y453F_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24571 - RNA, 4035 nt, Artificial Sequence
  SARS-CoV-2/Wuhan/WIV05/2019__EPI_ISL_402128 spike protein mRNA gc (1-1273)(D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcguggucuuccuccacgugacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24572 - RNA, 4035 nt, Artificial Sequence
  SARS-CoV-2/Wuhan/WIV05/2019__EPI_ISL_402128 spike protein mRNA gc (1-1273)(D614G_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24573 - RNA, 4029 nt, Artificial Sequence
  SARS-CoV-2/Wuhan/WIV05/2019__EPI_ISL_402128 spike protein mRNA gc (1-1273)(H69del_V70del_A222V_Y453F_S477N_D614G_I692V)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgugcuggagccucugguggaccugcccaucggcaucaacaucaccagguuccagacccugcuggcccugcaccggagcuaccugacccccggcgacagcagcagcggcuggaccgccggcgccgccgccuacuacgugggcuaccugcagccacggaccuuccugcugaaguacaacgagaacggcaccaucaccgacgcaguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgccgacagcuucgugauccggggcgacgaggugcggcagaucgcucccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcaacacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaauuucaacuucaacggccugaccggcaccggcgugcugaccgagagcaacaagaaguuccugcccuuccagcaguucggccgggauaucgccgacaccaccgacgccgugcgggacccccagacccuggagauccuggacaucaccccaugcagcuucggcggcgugagcgucaucacccccggcacaaacaccagcaaccagguggcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgccggcaucugcgcuuccuaccagacccagaccaacagcccccggcgggcccggagcguggccagccagagcgugaucgccuacaccaugagcuuaggcgccgagaacagcguggccuacagcaacaacagcaucgccaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcccgggaccugaucugcgcucagaaguucaacggccugaccgugcugcccccucugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaauuuuggcgccaucagcagcgugcugaacgacauccugucaaggcuggacaagguggaggccgaggugcagaucgaccggcugaucaccggccggcugcagagccugcagaccuacgugacccagcagcugauccgggccgccgagauccgggccagcgccaaccuggccgcaaccaagaugagcgagugcgugcugggccagagcaagcggguggacuucugcggcaagggcuaccaccugaugagcuucccccagagcgccccacacggcguggucuuccuccacgugacauacgugcccgcccaggagaagaacuucaccaccgcccccgccaucugccacgacggcaaggcccacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgcuagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24574 - RNA, 4029 nt, Artificial Sequence
  SARS-CoV-2/Wuhan/WIV05/2019__EPI_ISL_402128 spike protein mRNA gc (1-1273)(H69del_V70del_Y453F_D614G_I692V_M1229I)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguuccggcuguuccguaagagcaaccugaagccauuugagcgggacaucagcaccgagaucuaccaggccggcagcacccccugcaacgguguggagggcuucaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgugaucacccccggcacaaacaccagcaaccaggucgccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcgugaucgccuacaccaugagcuuaggcgccgagaacagcguggccuacagcaacaacagcaucgcgaucccuaccaacuucaccaucagcgugaccaccgagauccugcccgugagcaugaccaagaccagcguggacuguaccauguacauaugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuuuggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuucugcggcaagggcuaccaccugaugagcuucccccagagcgccccacacggcgugguguuccuccacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagauuaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugaucgugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24575 - RNA, 4026 nt, Artificial Sequence
  SARS-CoV-2/Wuhan/WIV05/2019__EPI_ISL_402128 spike protein mRNA gc (1-1273)(H69del_V70del_Y144del_N501Y_A570D_D614G_P681H_T716I_S982 A_D1118H)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccaucagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguaccacaagaacaacaagagcuggauggagagcgaguuccggguguacagcagcgcuaacaauugcaccuucgaguacgucagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaacuucaauggccugaccggcaccggcgugcugaccgagagcaacaagaaguuccugcccuuccagcaguucggccgggauaucgacgacaccaccgacgccgugcgggacccccagacccuggagauccuggacaucaccccaugcagcuucggcggcgugagcgugaucacccccggcacaaacaccagcaaccaggucgcagugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgccggcaucugcgcuagcuaccagacccagaccaacagccaccggcgggcccggagcguggccagccagagcaucaucgccuacaccaugagcuuaggcgccgagaacagcguggccuacagcaacaacagcaucgccauccccaucaacuucaccauaagcgugaccaccgagauccugccugugagcaugaccaagaccagcguggacuguaccauguacaucugcggcgacagcaccgagugcagcaaccugcugcugcaguacggcagcuucugcacccagcugaaccgggcgcugaccggcaucgccguggagcaggacaagaacacccaagagguguucgcccaggugaagcagaucuacaagaccccacccaucaaggacuucggcggcuucaacuucagccagauccugcccgaccccagcaagcccagcaagcggagcuucaucgaggaccugcuguucaacaaggugacucuggccgacgccggcuucaucaagcaguacggcgauugccugggggacaucgccgcccgggaccugaucugcgcucagaaguucaacggccugaccgugcugccuccccugcugaccgacgagaugaucgcccaguacaccagcgcccugcuugccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuucggcgccaucagcucagugcugaacgacauccuggccaggcuggacaagguggaggccgaggugcagaucgaccggcugaucaccggccggcugcagagccugcagaccuacgugacccagcagcugauccgggccgccgagauucgggccagcgccaaucuggcagccaccaagaugagcgagugcgugcugggccagagcaagcggguggacuuuugcggcaagggcuaccaccugaugagcuucccccagagcgcuccccacggcgugguguuccuccacgugaccuacgucccagcccaggagaagaacuucacaaccgcccccgccaucugccacgacggcaaggcccacuucccccgggagggaguguucgugagcaacggcacccacugguucgugacccagcggaacuucuacgagccccagaucaucaccacccacaacaccuucgugagcggcaacugcgacguggugaucggcaucgugaacaacaccguguacgacccccugcagcccgagcuggacagcuucaaggaggagcuggacaaguacuucaagaaccacaccagcccugacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24576 - RNA, 4035 nt, Artificial Sequence
  SARS-CoV-2/Wuhan/WIV05/2019__EPI_ISL_402128 spike protein mRNA gc (1-1273)(K417N_E484K_N501Y_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24577 - RNA, 4026 nt, Artificial Sequence
  SARS-CoV-2/Wuhan/WIV05/2019__EPI_ISL_402128 spike protein mRNA gc (1-1273)(L18F_D80A_D215G_L242del_A243del_L244del_R246I_K417N_E484 K_N501Y_D614G_A701V)
aggagaaagcuuaccauguucguguuccuggugcugcugccccuggugagcagccagugcgugaacuucaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgccaacccagugcugcccuucaacgacggcguguacuucgccagcaccgagaagucaaacaucauccggggcuggaucuuuggcaccacccuggacagcaagacacagagccugcugaucgugaacaacgcuaccaacguggugaucaaggugugcgaguuccaguucugcaacgaccccuuccugggcguguacuaccacaagaacaacaagagcuggauggagagcgaguuccgggucuacagcagcgccaacaauugcaccuucgaguacgugagccagcccuuccugauggaccuggagggcaagcagggcaacuucaagaaccuccgggaguucguguucaagaacaucgacggcuacuucaagaucuacagcaagcacacccccaucaaccuggugcggggacugccccagggcuucagcgcccuggagccucugguggaucugcccaucggcaucaacaucaccagguuccagacccugcacaucagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuuaagagcuucaccguggagaagggcaucuaccagaccagcaacuuccgggugcagcccacugagagcauugugcgguuccccaacaucaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaacaucgccgacuacaacuacaagcugcccgacgacuucaccggcugcgugaucgccuggaacagcaacaaccuggacagcaaggugggcggcaacuacaacuaccuguaccggcuauuccguaagagcaaccugaagccauuugagcgggacaucagcaccgagaucuaccaggccgguagcacccccugcaacggcgugaagggcuucaacugcuacuucccccugcagagcuacggcuuccagcccaccuacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggacaucgccgacaccaccgaugcagugcgggacccccagacccuggagauccuggacaucaccccaugcagcuucggcggcgugagcgucaucacccccggaacaaacaccagcaaccagguggccgugcuguaccagggcgugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagccugggcguggagaacagcguggccuacagcaacaacagcaucgccaucccuaccaacuucaccauaagcgugaccaccgagauccugcccgugagcaugaccaagaccagcguggacuguaccauguacaucugcggcgacagcaccgagugcagcaaccuguuacugcaguacggcagcuucugcacccagcugaaccgggcgcugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggggacugccugggcgacaucgccgcccgggaccugaucugcgcucagaaguucaacggccugaccgugcugcccccucugcugaccgaugagaugaucgcccaguacaccagcgcccugcuggccggcaccaucaccagcggcuggaccuucggcgccggcgccgcacugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcccaggcucugaacacccuggugaagcagcugagcagcaacuuuggcgccaucagcucagugcugaaugacauccugagccggcuggacaagguggaggccgaggugcagaucgacaggcugaucaccggccggcugcagagccugcagaccuacgugacccagcagcugauccgggccgccgagauucgggccagcgccaaccuggccgcaaccaagaugagcgagugcgugcugggccagagcaagcggguggacuucugcggcaagggcuaccaccugaugagcuucccccagagcgccccacacggcguggucuuccugcacgugacauacgugcccgcccaggagaagaacuucaccaccgcccccgccaucugccacgacggaaaggcccacuucccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcucgacaaguacuucaagaaccacaccagccccgacguggaccugggcgacaucagcggcaucaacgcuagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24578 - RNA, 4035 nt, Artificial Sequence
  SARS-CoV-2/Wuhan/WIV05/2019__EPI_ISL_402128 spike protein mRNA gc (1-1273)(E484K_D614G)
aggagaaagcuuaccauguucguguuccuggugcugcugccccuggugagcagccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcuggauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaagugcacccuaaagagcuucaccguggagaagggcaucuaccagaccagcaacuuccgggugcagcccacugagagcaucgugcgguuccccaacauuaccaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagccauucgagcgggacaucagcaccgagaucuaccaggccggcagcacccccugcaacggugugaagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacuccuacgagugcgacauccccaucggcgcuggcaucugcgccagcuaccagacccagaccaacagcccccggcgggcccggagcguggccagccagagcaucaucgccuacaccaugagcuuaggcgccgagaacagcguggccuacagcaacaacagcaucgcgaucccuaccaacuucaccaucagcgugaccaccgagauacugcccgugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuugccggcaccaucaccagcggcuggaccuucggcgccggcgcagcccugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcucagugcugaaugacauccugagcaggcuggacaagguggaggccgaggugcagaucgaccggcugaucaccggccggcugcagagccugcagaccuacgugacccagcagcugauccgggccgccgagauccgggccagcgccaaccuggcagccaccaagaugagcgagugcgugcugggccagagcaagcggguggacuuuugcggcaagggcuaccaccugaugagcuucccccagagcgccccacacggcgugguguuccuccacgucacauacgugcccgcccaggagaagaacuucaccaccgcccccgccauuugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccugcagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24579 - RNA, 4035 nt, Artificial Sequence
  SARS-CoV-2/Wuhan/WIV05/2019__EPI_ISL_402128 spike protein mRNA gc (1-1273)(L18F_T20N_P26S_D138Y_R190S_K417T_E484K_N501Y_D614G_H655Y _T1027I)
aggagaaagcuuaccauguucguguuccuggugcugcugccccuggugagcagccagugcgugaacuucaccaaccggacccagcugcccagcgccuacaccaacagcuucacccggggcguguacuacccugacaagguguuccggagcagcgugcugcacagcacccaggaccuguuccugcccuucuucagcaacgugaccugguuccacgccauccacgugagcggcaccaacggcaccaagcgguucgacaaccccgugcugccauucaacgacggcguguacuucgccagcaccgagaagucaaacaucauccggggcuggaucuuuggcaccacccuggacagcaagacccagagccugcugaucgugaacaacgccacaaacguggugaucaaggugugcgaguuccaguucugcaacuaccccuuccugggcguguacuaccacaagaacaacaagagcuggauggagagcgaguuccgggucuacagcagcgcuaauaacugcaccuucgaguacgugagccagcccuuccugauggaccuggagggcaagcagggcaacuucaagaaccucagcgaguucguguucaagaacaucgacggcuacuucaagaucuacagcaagcacacccccaucaaccuggugcgggaucugccccagggauucagcgcccuggagccccugguggaccugccuaucggcaucaacaucacccgguuccagacccugcuggcccugcacaggagcuaccugacccccggcgacagcagcagcggcuggaccgccggcgccgccgcauacuacgugggcuaccugcagccccggaccuuccugcugaaguacaacgagaacggcaccaucaccgacgccguggacugcgcccuggacccacugagcgagaccaagugcacccuaaagagcuucaccguggagaagggcaucuaccagaccagcaacuuccgggugcagcccaccgagagcaucgugcgguuccccaacauuacuaaccugugucccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgcugacagcuucgugauccggggcgacgaggugcggcagaucgccccuggccagaccggcaccaucgccgacuacaacuacaagcugcccgacgacuucaccggcugcgugaucgccuggaacagcaacaaccuggacagcaaggugggcggcaacuacaacuaccuguaccggcuguuccguaagagcaaccugaagcccuuugagcgggacaucagcaccgagaucuaccaggccggcagcaccccaugcaacggugugaagggcuucaacugcuacuucccccugcagagcuacggcuuccagcccaccuacggcgugggcuaccagcccuaccgggugguggugcugagcuucgagcugcugcacgcccccgccaccgugugcggccccaaaaagagcaccaaccuggugaagaacaagugcgugaacuucaauuucaacggccugaccggcaccggcgugcugaccgagagcaacaagaaguuccugccuuuccagcaguucggccgggacaucgccgauaccaccgacgcagugcgggacccccagacccuggagauccuggacaucacccccugcagcuucggcggcgugagcgucaucaccccaggcacaaacaccagcaaccagguggccgugcuguaccagggagugaacugcaccgaggugcccguggccauccacgccgaccagcugacccccaccuggcggguguacuccaccggcagcaacguguuccagacccgggccggcugccugaucggcgccgaguacgugaacaacagcuacgagugcgacauccccaucggcgcuggcaucugcgccagcuaccagacccagaccaacagcccccggcgggcccggagcguggccagccagagcaucaucgccuacaccaugagccugggcgccgagaacagcguggccuacagcaacaacagcaucgcgauccccaccaacuucaccaucagcgugaccaccgagauauuaccugugagcaugaccaagaccagcguggacuguaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacuccacccaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggacaucgccgcucgggaucugaucugcgcccagaaguucaacggccugaccgugcugccuccccugcugaccgacgagaugaucgcccaguacaccagcgcccugcuggccggcaccaucaccagcggcuggaccuucggcgccggcgcagcccuucagauccccuucgccaugcagauggccuaccgguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcucaaacuuuggcgccaucagcagcgugcugaaugacauccugagccggcuggacaagguggaggccgaggugcagaucgacaggcugaucaccggccggcugcagagccugcagaccuacgugacccagcagcugauccgggccgccgagauccgggccagcgccaaccuggcagccauuaagaugagcgagugcgugcugggccagagcaagcggguggacuucugcggcaagggcuaccaccugaugagcuucccccagagcgcuccccacggcgugguguuccugcacgucaccuacgugccagcccaggagaagaacuucacaaccgcccccgccaucugccacgacggcaaggcccacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagcccgagcuggacagcuucaaggaggagcuggacaaguacuucaagaaccacaccagcccugacguggaccugggcgauaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcuguagcugccugaagggcugcugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24580 - RNA, 4035 nt, Artificial Sequence
  SARS-CoV-2/Wuhan/WIV05/2019__EPI_ISL_402128 spike protein mRNA gc (1-1273)(S13I_W152C_L452R_D614G)
aggagaaagcuuaccauguucguguuccuggugcugcugccccuggugagcauccagugcgugaaccugaccacccggacccagcugcccccugccuacaccaacagcuucacccggggcguguacuaccccgacaagguguuccggagcagcgugcugcacagcacccaggaccuguuccugcccuucuucagcaacgugaccugguuccacgccauccacgugagcggcaccaacggcaccaagcgguucgacaacccagugcugcccuucaacgacggcguguacuucgccagcaccgagaagucaaacaucauccggggcuggaucuucggcaccacccuggacagcaagacacagagccugcugaucgugaacaacgccaccaacguggugaucaaggugugcgaguuucaguucugcaacgaccccuuccugggcguguacuaccacaagaacaacaagagcugcauggagagcgaguuccgggucuacagcagcgcuaacaauugcaccuucgaguacgugagccagcccuuccugauggaccucgagggcaagcagggcaacuucaagaaccugcgggaguucguguucaagaacaucgauggcuacuucaagaucuacagcaagcacacccccaucaaccuggugcgggaccugccccagggauucagcgcccuggagccucugguggaccugcccaucggcaucaacaucaccagguuccagacccugcuggcccugcaccggagcuaccugacccccggcgacagcagcagcggcuggaccgccggcgccgccgcauacuacgugggcuaccugcagccacggaccuuccugcugaaguacaacgagaacggcaccaucaccgacgccguggacugcgcccuggacccccugagcgagaccaaguguacccuaaagagcuucaccguggagaagggcaucuaccagaccagcaacuuccgggugcagcccacugagagcauugugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagcccuaccaagcugaacgaccugugcuucaccaacguguacgcugacagcuucgugauccggggcgacgaggugcggcagaucgcccccggccagaccggcaagaucgccgacuacaacuacaagcugcccgacgacuucaccggcugcgugaucgccuggaacagcaacaaccuggacagcaaggugggcggcaacuacaacuaccgguaccggcuguuccguaagagcaaccugaagccauucgagcgggacaucagcaccgagaucuaccaggccggcagcacccccugcaacgguguggagggcuuuaacugcuacuucccccugcagagcuacggcuuccagcccaccaacggcgugggcuaccagcccuaccgggugguggugcugagcuucgagcugcugcacgcccccgccaccgugugcggcccuaaaaagagcaccaaccuggugaagaacaagugcgugaacuucaauuucaacggccugaccggcaccggcgugcugaccgagagcaacaagaaguuccugcccuuccagcaguucggccgggauaucgccgacaccaccgacgcagugcgggacccccagacccuggagauccuggacaucaccccaugcagcuucggcggcgugagcgucaucacccccggcacaaacaccagcaaccagguggccgugcuguaccagggagugaacugcaccgaggugcccguggccauccacgccgaccagcugacccccaccuggcggguguacagcaccggcagcaacguguuccagacccgggccggcugccugaucggcgccgagcacgugaacaacagcuacgagugcgacauccccaucggcgcuggcaucugugccuccuaccagacccagaccaacagcccccggcgggcccggagcguggccagccagagcaucaucgccuacaccaugagccugggcgccgagaacagcguggccuacagcaacaacagcaucgcgaucccuaccaacuucaccauaagcgugaccaccgagaucuuacccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaagagguguucgcccaggugaagcagaucuacaagacucccccaaucaaggacuucggcggcuucaacuucagccagauccugcccgaccccagcaagcccagcaagcggagcuucaucgaggaccugcuguucaacaaggugacccuggccgacgccggcuucaucaagcaguacggcgacugccugggggauaucgccgcucgggaccugaucugcgcccagaaguucaacggccugaccgugcugcccccucugcugaccgacgagaugaucgcccaguacaccagcgcccugcuggccggcaccaucaccagcggcuggaccuucggcgccggcgcagcccuucagauccccuucgccaugcagauggccuacagguucaacggcaucggcgugacccagaacgugcuguacgagaaccagaagcugaucgccaaccaguucaacagcgccaucggcaagauccaggacagccugagcagcaccgccagcgcccugggcaagcugcaggacguggugaaccagaacgcucaggcccugaacacccuggugaagcagcugagcagcaacuucggcgccaucagcagcgugcugaaugacauccugucacggcuggacaagguggaggccgaggugcagaucgaccggcugaucaccggccggcugcagagccugcagaccuacgugacccagcagcugauccgggccgccgagauucgggccagcgccaaccuggcagccaccaagaugagcgagugcgugcugggccagagcaagcggguggacuuuugcggcaagggcuaccaccugaugagcuucccccagagcgccccacacggcgugguguuccugcacgucacauacgugcccgcccaggagaagaacuucaccaccgcccccgccaucugccacgacggcaaggcucacuucccccgggagggaguguucgugagcaacggcacccacugguucgugacccagcggaacuucuacgagccccagaucaucaccaccgacaacaccuucgugagcggcaacugcgacguggugaucggcaucgugaacaacaccguguacgacccccuccagccugagcuggacagcuucaaggaggagcuggacaaguacuucaagaaccacaccagccccgacguggaucugggcgacaucagcggcaucaacgccagcguggugaacauccagaaggagaucgaccggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcuguugcagcugccugaagggcugcugcagcugcggcagcugcugcaaguucgacgaggacgacagcgagccagugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24581 - RNA, 4035 nt, Artificial Sequence
  SARS-CoV-2/Wuhan/WIV05/2019__EPI_ISL_402128 spike protein mRNA gc mod (1-1273)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24582 - RNA, 4035 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24583 - RNA, 4035 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24584 - RNA, 4035 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24585 - RNA, 4035 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24586 - RNA, 4035 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24587 - RNA, 4029 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24588 - RNA, 4035 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24589 - RNA, 4035 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24590 - RNA, 4035 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24591 - RNA, 4029 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcaacaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24592 - RNA, 4029 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcgugauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24593 - RNA, 4026 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccacagacgggcuagaagcguggccagccagagcaucauugccuacacaaugucucugggcgccgagaacagcguggccuacuccaacaacucuaucgcuauccccaucaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24594 - RNA, 4035 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24595 - RNA, 4026 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuucuggugcugcugccccugguguccagccagugugugaacuucaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcguggagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24596 - RNA, 4035 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuucuggugcugcugccccugguguccagccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24597 - RNA, 4035 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuucuggugcugcugccccugguguccagccagugugugaacuucaccaacagaacacagcugccuagcgccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucagcaccgaaaucuaucaggccggcagcaccccuugcaacggcgugaagggcuucaacugcuacuucccacugcaguccuacggcuuucagcccacauacggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24598 - RNA, 4035 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuucuggugcugcugccccugguguccauccagugugugaaccugaccaccagaacacagcugccuccagccuacaccaacagcuucaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguucaagaacaucgacggcuacuucaaaaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucagcaccgaaaucuaucaggccggcagcaccccuugcaacggcguggaaggcuucaacugcuacuucccacugcaguccuacggcuuucagcccacaaauggcgugggcuaucagcccuacagagugguggugcugagcuucgaacugcugcaugcuccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccaugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggcaucugugccagcuaccagacacagacaaacagccccagacgggcuagaagcguggccagccagagcaucauugccuacacaaugucucugggcgccgagaacagcguggccuacuccaacaacucuaucgcuauccccaccaacuucaccaucagcgugaccaccgagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcaaaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcuggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacguugugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24599 - RNA, 4035 nt, Artificial Sequence
  SARS-CoV-2/Wuhan/WIV05/2019__EPI_ISL_402128 spike protein mRNA gc mod (1-1273)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccaggacgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24600 - RNA, 4035 nt, Artificial Sequence
  SARS-CoV-2/Wuhan/WIV05/2019__EPI_ISL_402128 spike protein mRNA gc mod (1-1273)(D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24601 - RNA, 4035 nt, Artificial Sequence
  SARS-CoV-2/Wuhan/WIV05/2019__EPI_ISL_402128 spike protein mRNA gc mod (1-1273)(A222V_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24602 - RNA, 4035 nt, Artificial Sequence
  SARS-CoV-2/Wuhan/WIV05/2019__EPI_ISL_402128 spike protein mRNA gc mod (1-1273)(N439K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaagaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24603 - RNA, 4035 nt, Artificial Sequence
  SARS-CoV-2/Wuhan/WIV05/2019__EPI_ISL_402128 spike protein mRNA gc mod (1-1273)(S477N_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24604 - RNA, 4035 nt, Artificial Sequence
  SARS-CoV-2/Wuhan/WIV05/2019__EPI_ISL_402128 spike protein mRNA gc mod (1-1273)(N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24605 - RNA, 4029 nt, Artificial Sequence
  SARS-CoV-2/Wuhan/WIV05/2019__EPI_ISL_402128 spike protein mRNA gc mod (1-1273)(H69del_V70del_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24606 - RNA, 4035 nt, Artificial Sequence
  SARS-CoV-2/Wuhan/WIV05/2019__EPI_ISL_402128 spike protein mRNA gc mod (1-1273)(Y453F_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24607 - RNA, 4035 nt, Artificial Sequence
  SARS-CoV-2/Wuhan/WIV05/2019__EPI_ISL_402128 spike protein mRNA gc mod (1-1273)(D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24608 - RNA, 4035 nt, Artificial Sequence
  SARS-CoV-2/Wuhan/WIV05/2019__EPI_ISL_402128 spike protein mRNA gc mod (1-1273)(D614G_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24609 - RNA, 4029 nt, Artificial Sequence
  SARS-CoV-2/Wuhan/WIV05/2019__EPI_ISL_402128 spike protein mRNA gc mod (1-1273)(H69del_V70del_A222V_Y453F_S477N_D614G_I692V)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugugcuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcaacaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24610 - RNA, 4029 nt, Artificial Sequence
  SARS-CoV-2/Wuhan/WIV05/2019__EPI_ISL_402128 spike protein mRNA gc mod (1-1273)(H69del_V70del_Y453F_D614G_I692V_M1229I)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguuccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcgugauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugaucgucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24611 - RNA, 4026 nt, Artificial Sequence
  SARS-CoV-2/Wuhan/WIV05/2019__EPI_ISL_402128 spike protein mRNA gc mod (1-1273)(H69del_V70del_Y144del_N501Y_A570D_D614G_P681H_T716I_S982 A_D1118H)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccaucuccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgacgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagccaccggagagccagaagcguggccagccagagcaucauugccuacacaaugucucugggcgccgagaacagcguggccuacuccaacaacucuaucgcuauccccaucaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccuggccagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccacccacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24612 - RNA, 4035 nt, Artificial Sequence
  SARS-CoV-2/Wuhan/WIV05/2019__EPI_ISL_402128 spike protein mRNA gc mod (1-1273)(K417N_E484K_N501Y_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24613 - RNA, 4026 nt, Artificial Sequence
  SARS-CoV-2/Wuhan/WIV05/2019__EPI_ISL_402128 spike protein mRNA gc mod (1-1273)(L18F_D80A_D215G_L242del_A243del_L244del_R246I_K417N_E484 K_N501Y_D614G_A701V)
aggagaaagcuuaccauguucguguuccuggugcugcugccucugguguccagccagugugugaacuucaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgccaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcggggccugccucagggcuucucugcucuggaaccccugguggaucugcccaucggcaucaacaucacccgguuucagacacugcacaucagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaacaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcguggagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24614 - RNA, 4035 nt, Artificial Sequence
  SARS-CoV-2/Wuhan/WIV05/2019__EPI_ISL_402128 spike protein mRNA gc mod (1-1273)(E484K_D614G)
aggagaaagcuuaccauguucguguuccuggugcugcugccucugguguccagccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24615 - RNA, 4035 nt, Artificial Sequence
  SARS-CoV-2/Wuhan/WIV05/2019__EPI_ISL_402128 spike protein mRNA gc mod (1-1273)(L18F_T20N_P26S_D138Y_R190S_K417T_E484K_N501Y_D614G_H655Y _T1027I)
aggagaaagcuuaccauguucguguuccuggugcugcugccucugguguccagccagugugugaacuucaccaacagaacacagcugccuagcgccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacuaccccuuccugggcgucuacuaccacaagaacaacaagagcuggauggaaagcgaguuccggguguacagcagcgccaacaacugcaccuucgaguacgugucccagccuuuccugauggaccuggaaggcaagcagggcaacuucaagaaccugagcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaccaucgccgacuacaacuacaagcugcccgacgacuucaccggcugugugauugccuggaacagcaacaaccuggacuccaaagucggcggcaacuacaauuaccuguaccggcuguuccggaaguccaaucugaagcccuucgagcgggacaucuccaccgagaucuaucaggccggcagcaccccuuguaacggcgugaagggcuucaacugcuacuucccacugcaguccuacggcuuucagcccacauacggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgaguacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaucaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24616 - RNA, 4035 nt, Artificial Sequence
  SARS-CoV-2/Wuhan/WIV05/2019__EPI_ISL_402128 spike protein mRNA gc mod (1-1273)(S13I_W152C_L452R_D614G)
aggagaaagcuuaccauguucguguuccuggugcugcugccucugguguccauccagugugugaaccugaccaccagaacacagcugccuccagccuacaccaacagcuuuaccagaggcguguacuaccccgacaagguguucagauccagcgugcugcacucuacccaggaccuguuccugccuuucuucagcaacgugaccugguuccacgccauccacguguccggcaccaauggcaccaagagauucgacaaccccgugcugcccuucaacgacgggguguacuuugccagcaccgagaaguccaacaucaucagaggcuggaucuucggcaccacacuggacagcaagacccagagccugcugaucgugaacaacgccaccaacguggucaucaaagugugcgaguuccaguucugcaacgaccccuuccugggcgucuacuaccacaagaacaacaagagcugcauggaaagcgaguuccggguguacagcagcgccaacaacugcaccuucgaguacgugucccagccuuuccugauggaccuggaaggcaagcagggcaacuucaagaaccugcgcgaguucguguuuaagaacaucgacggcuacuucaagaucuacagcaagcacaccccuaucaaccucgugcgggaucugccucagggcuucucugcucuggaaccccugguggaucugcccaucggcaucaacaucacccgguuucagacacugcuggcccugcacagaagcuaccugacaccuggcgauagcagcagcggauggacagcuggugccgccgcuuacuaugugggcuaccugcagccuagaaccuuccugcugaaguacaacgagaacggcaccaucaccgacgccguggauugugcucuggauccucugagcgagacaaagugcacccugaaguccuucaccguggaaaagggcaucuaccagaccagcaacuuccgggugcagcccaccgaauccaucgugcgguuccccaauaucaccaaucugugccccuucggcgagguguucaaugccaccagauucgccucuguguacgccuggaaccggaagcggaucagcaauugcguggccgacuacuccgugcuguacaacuccgccagcuucagcaccuucaagugcuacggcguguccccuaccaagcugaacgaccugugcuucacaaacguguacgccgacagcuucgugauccggggagaugaagugcggcagauugccccuggacagacaggcaagaucgccgacuacaacuacaagcugcccgacgacuucaccggcugugugauugccuggaacagcaacaaccuggacuccaaagucggcggcaacuacaauuaccgcuaccggcuguuccggaaguccaaucugaagcccuucgagcgggacaucuccaccgagaucuaucaggccggcagcaccccuuguaacggcguggaaggcuucaacugcuacuucccacugcaguccuacggcuuucagcccacaaauggcgugggcuaucagcccuacagagugguggugcugagcuucgaacugcugcaugccccugccacagugugcggcccuaagaaaagcaccaaucucgugaagaacaaaugcgugaacuucaacuucaacggccugaccggcaccggcgugcugacagagagcaacaagaaguuccugccauuccagcaguuuggccgggauaucgccgauaccacagacgccguuagagauccccagacacuggaaauccuggacaucaccccuugcagcuucggcggagugucugugaucaccccuggcaccaacaccagcaaucagguggcagugcuguaccagggcgugaacuguaccgaagugcccguggccauucacgccgaucagcugacaccuacauggcggguguacuccaccggcagcaauguguuucagaccagagccggcugucugaucggagccgagcacgugaacaauagcuacgagugcgacauccccaucggcgcuggaaucugcgccagcuaccagacacagacaaacagcccucggagagccagaagcguggccagccagagcaucauugccuacacaaugucucugggcgccgagaacagcguggccuacuccaacaacucuaucgcuauccccaccaacuucaccaucagcgugaccacagagauccugccuguguccaugaccaagaccagcguggacugcaccauguacaucugcggcgauuccaccgagugcuccaaccugcugcugcaguacggcagcuucugcacccagcugaauagagcccugacagggaucgccguggaacaggacaagaacacccaagagguguucgcccaagugaagcagaucuacaagaccccuccuaucaaggacuucggcggcuucaauuucagccagauucugcccgauccuagcaagcccagcaagcggagcuucaucgaggaccugcuguucaacaaagugacacuggccgacgccggcuucaucaagcaguauggcgauugucugggcgacauugccgccagggaucugauuugcgcccagaaguuuaacggacugacagugcugccuccucugcugaccgaugagaugaucgcccaguacacaucugcccugcuggccggcacaaucacaagcggcuggacauuuggagcaggcgccgcucugcagauccccuuugcuaugcagauggccuaccgguucaacggcaucggagugacccagaaugugcuguacgagaaccagaagcugaucgccaaccaguucaacagcgccaucggcaagauccaggacagccugagcagcacagcaagcgcccugggaaagcugcaggacguggucaaccagaaugcccaggcacugaacacccuggucaagcagcuguccuccaacuucggcgccaucagcucugugcugaacgauauccugagcagacuggacaaggucgaggccgaggugcagaucgacagacugaucacaggcagacugcagagccuccagacauacgugacccagcagcugaucagagccgccgagauuagagccucugccaaucuggccgccaccaagaugucugagugugugcugggccagagcaagagaguggacuuuugcggcaagggcuaccaccugaugagcuucccucagucugccccucacggcgugguguuucugcacgugacauaugugcccgcucaagagaagaauuucaccaccgcuccagccaucugccacgacggcaaagcccacuuuccuagagaaggcguguucguguccaacggcacccauugguucgugacacagcggaacuucuacgagccccagaucaucaccaccgacaacaccuucgugucuggcaacugcgacgucgugaucggcauugugaacaauaccguguacgacccucugcagcccgagcuggacagcuucaaagaggaacuggacaaguacuuuaagaaccacacaagccccgacguggaccugggcgauaucagcggaaucaaugccagcgucgugaacauccagaaagagaucgaccggcugaacgagguggccaagaaucugaacgagagccugaucgaccugcaagaacuggggaaguacgagcaguacaucaaguggcccugguacaucuggcugggcuuuaucgccggacugauugccaucgugauggucacaaucaugcuguguugcaugaccagcugcuguagcugccugaagggcuguuguagcuguggcagcugcugcaaguucgacgaggacgauucugagcccgugcugaagggcgugaaacugcacuacacaugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24617 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24618 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24619 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24620 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24621 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24622 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24623 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24624 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24625 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24626 - RNA, 4035 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24627 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcguccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcaacacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24628 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcgugaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugaucgugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24629 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgacgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacucccaccggcgcgcccggagcguggcgucccagagcaucaucgccuacaccaugucccugggcgccgagaacagcgucgccuacuccaacaacagcaucgccauccccaucaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucgcccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccacccacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24630 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24631 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgccaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccggggccugccccagggguucagcgcccucgagccccugguggaccugcccaucggcaucaacaucacccgcuuccagacccuccacaucuccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcguggagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24632 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24633 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacgcagcugccgagcgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacuaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccucagcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaccaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggaguacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaucaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24634 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcugcauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccgcuaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgaggugcagaucgaccggcugaucaccgggcgccuccagagccugcagaccuacgugacccagcagcugauccgggcggccgagauccgcgccagcgccaaccucgccgcgaccaagauguccgagugcguccugggccagagcaagcggguggacuucugcggcaagggguaccaccugauguccuucccccagagcgccccgcacggcguggucuuccuccacgugacguacguccccgcccaggagaagaacuucaccaccgcccccgcgaucugccacgacgggaaggcccacuucccccgcgagggcguguucguguccaacgggacccacugguucgucacgcagcggaacuucuacgagccgcagaucaucaccaccgacaacaccuucgugagcggcaacugcgacguggucaucggcaucgugaacaacacgguguacgacccccugcagcccgagcuggacuccuucaaggaggagcucgacaaguacuucaagaaccacaccagccccgacgucgaccugggggacaucuccggcaucaacgccagcguggugaacauccagaaggagaucgaccgccugaacgaggucgccaagaaccucaacgagucccugaucgaccugcaggagcucgggaaguacgagcaguacaucaaguggccgugguacaucuggcugggcuucaucgccggccugaucgcgaucgugauggugaccaucaugcucugcugcaugaccagcugcugcuccugccugaaggggugcugcagcugcggcuccugcugcaaguucgacgaggacgacagcgagcccguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24635 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccaggacgugaacugcaccgagguccccguggccauccacgccgaccagcugacgcccaccuggcggguguacuccaccggcagcaacgucuuccagacccgcgccgggugccucaucggcgcggagcacgugaacaacuccuacgagugcgacauccccaucggggccggcaucugcgccagcuaccagacgcagaccaacuccccgcggcgcgcccggagcguggcgucccagagcaucaucgccuacaccaugucccugggcgccgagaacagcgucgccuacuccaacaacagcaucgccauccccaccaacuucacgaucuccgugaccaccgagauccugcccgugagcaugaccaagacgagcgucgacugcaccauguacaucugcggggacuccaccgagugcagcaaccuccugcugcaguacggcuccuucugcacccagcucaaccgcgcgcugacggggaucgccguggagcaggacaagaacacccaggagguguucgcccaggucaagcagaucuacaagacgcccccgaucaaggacuucggcggguucaacuucagccagauccugcccgaccccuccaagcccagcaagcgguccuucaucgaggaccuccuguucaacaaggugacccuggccgacgccggcuucaucaagcaguacggcgacugccucggggacaucgcggcccgcgaccugaucugcgcccagaaguucaacggccugaccgugcucccgccccugcugaccgacgagaugaucgcccaguacaccagcgcccuccuggcggggaccaucacguccggcuggaccuucggggccggcgccgcccugcagauccccuucgcgaugcagauggccuaccgguucaacggcaucggggucacccagaacgugcucuacgagaaccagaagcugaucgccaaccaguucaacagcgccaucggcaagauccaggacucccugagcuccaccgccagcgcgcucgggaagcugcaggacguggucaaccagaacgcccaggcccugaacacgcucgugaagcagcuguccagcaacuucggcgccaucuccagcgugcugaacgacauccucucccgccuggacccgcccgaggccgagguccagaucgaccggcugaucaccgggcgccuccagagccugcagaccuacgugacccagcagcugauccgggcggccgagauccgcgccagcgccaaccucgccgcgaccaagauguccgagugcgugcugggccagagcaagcgggucgacuucugcggcaagggguaccaccugauguccuucccccagagcgcgccccacggcgugguguuccuccacgucacguacgugcccgcccaggagaagaacuucaccaccgccccggccaucugccacgacgggaaggcccacuucccccgcgagggcgucuucguguccaacgggacccacugguucgugacgcagcggaacuucuacgagccccagaucaucaccaccgacaacaccuucgucagcggcaacugcgacguggugaucggcaucgucaacaacacgguguacgacccccugcagccggagcuggacuccuucaaggaggagcucgacaaguacuucaagaaccacaccagccccgacguggaccugggggacaucuccggcaucaacgccagcgucgugaacauccagaaggagaucgaccgccugaacgagguggccaagaaccucaacgagucccugaucgaccugcaggagcucgggaaguacgagcaguacaucaaguggcccugguacaucuggcugggcuucaucgccggccugaucgcgaucgucauggugaccaucaugcucugcugcaugaccagcugcugcuccugccugaaggggugcugcagcugcggcuccugcugcaaguucgacgaggacgacagcgagccggugcugaagggggucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24636 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24637 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgugcucgagccccugguggaccugcccaucggcaucaacaucacccgcuuccagacccuccuggcccugcaccgguccuaccucacgccgggggacagcagcuccggcuggaccgccggcgcggccgccuacuacgucggguaccugcagccccgcaccuuccugcucaaguacaacgagaacggcaccaucacggacgccguggacugcgcgcuggacccccugagcgagaccaagugcacccucaaguccuucaccguggagaaggggaucuaccagacgagcaacuuccggguccagcccaccgaguccaucgugcgcuucccgaacaucaccaaccugugccccuucggcgaggucuucaacgccacccgguucgccagcguguacgccuggaaccgcaagcggaucuccaacugcguggccgacuacagcguccuguacaacuccgcgagcuucuccacguucaagugcuacggcgugagccccaccaagcucaacgaccugugcuucaccaacguguacgccgacuccuucgucauccgcggggacgaggugcggcagaucgcccccggccagaccgggaagaucgccgacuacaacuacaagcugccggacgacuucacgggcugcgugaucgccuggaacagcaacaaccucgacuccaaggucgggggcaacuacaacuaccuguaccgccuguuccgcaagagcaaccucaagcccuucgagcgggacaucuccaccgagaucuaccaggcgggcagcacccccugcaacgggguggagggcuucaacugcuacuucccccugcaguccuacggguuccagccgaccaacggcgugggguaccagcccuaccgggucguggugcugagcuucgagcuccugcacgcccccgccacggucugcggccccaagaaguccaccaaccuggugaagaacaagugcgugaacuucaacuucaacggccucaccgggaccggcguccugaccgagagcaacaagaaguuccugccguuccagcaguucgggcgcgacaucgccgacacgaccgacgccgugcgcgacccccagacccuggagauccucgacaucacccccugcagcuucggcgggguguccgucaucacgccgggcaccaacaccagcaaccagguggcggugcuguaccagggcgucaacugcaccgaggugcccguggccauccacgccgaccagcugacgcccaccuggcgggucuacuccaccgggagcaacguguuccagacccgcgccggcugccucaucggggccgagcacgugaacaacuccuacgagugcgacauccccaucggcgcgggcaucugcgccagcuaccagacgcagaccaacuccccgcggcgcgcccggagcgucgccucccagagcaucaucgcguacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcccugacgggcaucgcgguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccagcgcccuccuggccggcaccaucacguccggguggaccuucggcgcgggcgccgcccugcagauccccuucgccaugcagauggcguaccgguucaacgggaucggcgugacccagaacgugcucuacgagaaccagaagcugaucgccaaccaguucaacagcgccaucgggaagauccaggacucccugagcuccaccgccagcgcccucggcaagcugcaggacgucgugaaccagaacgcgcaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggccgcggagauccgcgccagcgccaaccucgccgccaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcgcacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgccaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24638 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaagaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24639 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcggggugagcgugaucacgccgggcaccaacaccuccaaccaggucgccgugcuguaccagggcgugaacugcaccgagguccccguggccauccacgccgaccagcugacgcccaccuggcggguguacagcaccggguccaacgucuuccagacccgcgccggcugccucaucggggcggagcacgugaacaacagcuacgagugcgacauccccaucggcgccggcaucugcgccuccuaccagacgcagaccaacagcccgcggcgcgcccgguccguggcgagccaguccaucaucgccuacaccaugagccugggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccuccugcugcaguacgggagcuucugcacccagcucaaccgcgcgcugacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccuccgcccuccuggcgggcaccaucacgagcggguggaccuucggcgccggcgccgcccugcagauccccuucgcgaugcagauggccuaccgguucaacgggaucggcgucacccagaacgugcucuacgagaaccagaagcugaucgccaaccaguucaacuccgccaucgggaagauccaggacagccuguccagcaccgccuccgcgcucggcaagcugcaggacguggucaaccagaacgcccaggcccugaacacgcucgugaagcagcugagcuccaacuucggggccaucagcuccgugcugaacgacauccucagccgccuggacccgcccgaggccgagguccagaucgaccggcugaucaccggccgccuccagucccugcagaccuacgugacccagcagcugauccgggcggccgagauccgcgccagcgccaaccucgccgcgaccaagaugagcgagugcgugcugggccaguccaagcgggucgacuucugcgggaagggcuaccaccugaugagcuucccccaguccgcgccccacggggugguguuccuccacgucacguacgugcccgcccaggagaagaacuucaccaccgccccggccaucugccacgacggcaaggcccacuucccccgcgagggggucuucgugagcaacggcacccacugguucgugacgcagcggaacuucuacgagccccagaucaucaccaccgacaacaccuucgucuccggcaacugcgacguggugaucgggaucgucaacaacacgguguacgacccccugcagccggagcuggacagcuucaaggaggagcucgacaaguacuucaagaaccacaccucccccgacguggaccugggcgacaucagcgggaucaacgccuccgucgugaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgucauggugaccaucaugcucugcugcaugaccuccugcugcagcugccugaagggcugcugcuccugcgggagcugcugcaaguucgacgaggacgacuccgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24640 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24641 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcguggccuacuccaacaacagcaucgccauccccaccaacuucacgaucuccgucaccaccgagauccugcccgugagcaugaccaagacgagcguggacugcaccauguacaucugcggcgacuccaccgagugcagcaaccuccugcugcaguacggguccuucugcacccagcucaaccgcgcgcugacgggcaucgccgucgagcaggacaagaacacccaggagguguucgcccaggugaagcagaucuacaagacgcccccgaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacguccucuacgagaaccagaagcugaucgccaaccaguucaacagcgccaucgggaagauccaggacucccugagcuccaccgccagcgcgcucggcaagcugcaggacguggugaaccagaacgcccaggcccugaacacgcucgucaagcagcuguccagcaacuucggggccaucuccagcgugcugaacgacauccucucccgccuggacccgcccgaggccgaggugcagaucgaccggcugaucaccggccgccuccagagccugcagaccuacgucacccagcagcugauccgggcggccgagauccgcgccagcgccaaccucgccgcgaccaagauguccgagugcgugcugggccagagcaagcggguggacuucugcgggaagggcuaccaccugauguccuucccccagagcgcgccccacggggucguguuccuccacgugacguacguccccgcccaggagaagaacuucaccaccgccccggccaucugccacgacggcaaggcccacuucccccgcgaggggguguucgucuccaacggcacccacugguucgugacgcagcggaacuucuacgagccccagaucaucaccaccgacaacaccuucgugagcggcaacugcgacgucgugaucgggaucgugaacaacacggucuacgacccccugcagccggagcuggacuccuucaaggaggagcucgacaaguacuucaagaaccacaccagccccgacguggaccugggcgacaucuccgggaucaacgccagcguggucaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgugauggucaccaucaugcucugcugcaugaccagcugcugcuccugccugaagggcugcugcagcugcggguccugcugcaaguucgacgaggacgacagcgagccggugcugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24642 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24643 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcgucaucgccuacaccaugucccugggggccgagaacagcguggccuacuccaacaacagcaucgccauccccaccaacuucacgaucuccgugaccaccgagauccugcccgucagcaugaccaagacgagcguggacugcaccauguacaucugcggcgacuccaccgagugcagcaaccuccugcugcaguacggguccuucugcacccagcucaaccgcgcgcugacgggcaucgccguggagcaggacaagaacacccaggaggucuucgcccaggugaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccguccucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgugacccagaacgugcucuacgagaaccagaagcugaucgccaaccaguucaacagcgccaucgggaagauccaggacucccugagcuccaccgccagcgcgcucggcaagcugcaggacgucgugaaccagaacgcccaggcccugaacacgcucgugaagcagcuguccagcaacuucggggccaucuccagcguccugaacgacauccucucccgccuggacccgcccgaggccgaggugcagaucgaccggcugaucaccggccgccuccagagccugcagaccuacgugacccagcagcugauccgggcggccgagauccgcgccagcgccaaccucgccgcgaccaagauguccgagugcguccugggccagagcaagcggguggacuucugcgggaagggcuaccaccugauguccuucccccagagcgcgccccacgggguggucuuccuccacgugacguacguccccgcccaggagaagaacuucaccaccgccccggccaucugccacgacggcaaggcccacuucccccgcgaggggguguucguguccaacggcacccacugguucgucacgcagcggaacuucuacgagccccagaucaucaccaccgacaacaccuucgugagcggcaacugcgacguggucaucgggaucgugaacaacacgguguacgacccccugcagccggagcuggacuccuucaaggaggagcucgacaaguacuucaagaaccacaccagccccgacgucgaccugggcgacaucuccgggaucaacgccagcguggugaacauccagaaggagaucgaccgccugaacgaggucgccaagaaccucaacgagucccugaucgaccugcaggagcucggcaaguacgagcaguacaucaaguggcccugguacaucuggcugggcuucaucgccgggcugaucgcgaucgugauggugaccaucaugcucugcugcaugaccagcugcugcuccugccugaagggcugcugcagcugcggguccugcugcaaguucgacgaggacgacagcgagccgguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24644 - RNA, 4035 nt, Artificial Sequence
  SARS-CoV-2/Wuhan/WIV05/2019__EPI_ISL_402128 spike protein mRNA gc (1-1273)(K986P_V987P_D614G_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24645 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_A222V_Y453F_S477N_D614G_I692V)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcguccucgagccccugguggaccugcccaucggcaucaacaucacccgcuuccagacccuccuggcccugcaccgguccuaccucacgccgggggacagcagcuccggcuggaccgccggcgcggccgccuacuacgugggguaccugcagccccgcaccuuccugcucaaguacaacgagaacggcaccaucacggacgccgucgacugcgcgcuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggccgacuacagcgugcuguacaacuccgcgagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgccuggaacagcaacaaccucgacuccaaggucgggggcaacuacaacuaccuguuccgccuguuccgcaagagcaaccucaagcccuucgagcgggacaucuccaccgagaucuaccaggcgggcaacacccccugcaacgggguggagggcuucaacugcuacuucccccugcagagcuacggguuccagccgaccaacggcgugggguaccagcccuaccggguggucgugcuguccuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgccguccgcgacccccagacccuggagauccucgacaucacccccugcagcuucggcggggugagcgugaucacgccgggcaccaacaccuccaaccaggucgcggugcuguaccagggcgugaacugcaccgagguccccguggccauccacgccgaccagcugacgcccaccuggcggguguacagcaccggguccaacgucuuccagacccgcgccggcugccucaucggggccgagcacgugaacaacagcuacgagugcgacauccccaucggcgcgggcaucugcgccuccuaccagacgcagaccaacagcccgcggcgcgcccgguccguggccagccaguccgucaucgcguacaccaugagccugggggccgagaacuccguggccuacagcaacaacuccaucgccauccccaccaacuucacgaucagcgugaccaccgagauccugcccgucuccaugaccaagacgagcguggacugcaccauguacaucugcggcgacagcaccgagugcuccaaccuccugcugcaguacgggagcuucugcacccagcucaaccgcgcccugacgggcaucgcgguggagcaggacaagaacacccaggaggucuucgcccaggugaagcagaucuacaagacgcccccgaucaaggacuucgggggcuucaacuucucccagauccugcccgaccccagcaagcccuccaagcggagcuucaucgaggaccuccuguucaacaaggugacccuggccgacgccggcuucaucaagcaguacggggacugccucggcgacaucgccgcgcgcgaccugaucugcgcccagaaguucaacgggcugaccguccucccgccccugcugaccgacgagaugaucgcccaguacaccuccgcccuccuggccggcaccaucacgagcggguggaccuucggcgcgggcgccgcccugcagauccccuucgccaugcagauggcguaccgguucaacgggaucggcgugacccagaacgugcucuacgagaaccagaagcugaucgccaaccaguucaacuccgccaucgggaagauccaggacagccuguccagcaccgccuccgcccucggcaagcugcaggacgucgugaaccagaacgcgcaggcccugaacacgcucgugaagcagcugagcuccaacuucggggccaucagcuccguccugaacgacauccucagccgccuggacccgcccgaggccgaggugcagaucgaccggcugaucaccggccgccuccagucccugcagaccuacgugacccagcagcugauccgggccgcggagauccgcgccagcgccaaccucgccgccaccaagaugagcgagugcguccugggccaguccaagcggguggacuucugcgggaagggcuaccaccugaugagcuucccccaguccgcgccccacgggguggucuuccuccacgugacguacguccccgcccaggagaagaacuucaccaccgccccggccaucugccacgacggcaaggcgcacuucccccgcgaggggguguucgugagcaacggcacccacugguucgucacgcagcggaacuucuacgagccccagaucaucaccaccgacaacaccuucguguccggcaacugcgacguggucaucgggaucgugaacaacacgguguacgacccccugcagccggagcuggacagcuucaaggaggagcucgacaaguacuucaagaaccacaccucccccgacgucgaccugggcgacaucagcgggaucaacgccuccguggugaacauccagaaggagaucgaccgccugaacgaggucgccaagaaccucaacgagagccugaucgaccugcaggagcucggcaaguacgagcaguacaucaaguggcccugguacaucuggcugggcuucaucgccgggcugaucgccaucgugauggugaccaucaugcucugcugcaugaccuccugcugcagcugccugaagggcugcugcuccugcgggagcugcugcaaguucgacgaggacgacuccgagccgguccugaagggcgugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24646 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_Y453F_D614G_I692V_M1229I)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguacuaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguuccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccaacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgccgacacgaccgacgcggugcgcgacccccagacccuggagauccucgacaucacccccugcagcuucggcggggucuccgugaucacgccgggcaccaacaccagcaaccagguggccguccuguaccagggcgugaacugcaccgaggugcccgucgccauccacgccgaccagcugacgcccaccuggcggguguacuccaccgggagcaacguguuccagacccgcgccggcugccucaucggggcggagcacgucaacaacuccuacgagugcgacauccccaucggcgccggcaucugcgccagcuaccagacgcagaccaacuccccgcggcgcgcccggagcguggcgucccagagcgugaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucaucgugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24647 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_H69del_V70del_Y144del_N501Y_A570 D_D614G_P681H_T716I_S982A_D1118H)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccaucuccgggaccaacggcaccaagcgguucgacaacccggugcugcccuucaacgacgggguguacuucgcgagcaccgagaaguccaacaucauccgcggcuggaucuucgggacgacccucgacagcaagacccagucccugcugaucgucaacaacgccaccaacguggugaucaaggucugcgaguuccaguucugcaacgaccccuuccucggcguguaccacaagaacaacaagagcuggauggaguccgaguuccggguguacagcuccgccaacaacugcacguucgaguacgucagccagcccuuccugauggaccuggagggcaagcaggggaacuucaagaaccuccgcgaguucguguucaagaacaucgacggcuacuucaagaucuacuccaagcacaccccgaucaaccuggugcgggaccugccccagggguucagcgcccucgagccccuggucgaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcgguggacugcgcccuggacccccugagcgagaccaagugcacccucaaguccuucaccgucgagaaggggaucuaccagacgagcaacuuccgggugcagcccaccgaguccaucgugcgcuucccgaacaucaccaaccugugccccuucggcgaggucuucaacgccacccgguucgccagcguguacgccuggaaccgcaagcggaucuccaacugcgucgcggacuacagcgugcuguacaacuccgccagcuucuccacguucaagugcuacggcgugagccccaccaagcucaacgaccugugcuucaccaacgucuacgccgacuccuucgugauccgcggggacgaggugcggcagaucgcccccggccagaccgggaagaucgccgacuacaacuacaagcugccggacgacuucacgggcugcgucaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacgggguggagggcuucaacugcuacuucccccugcaguccuacggguuccagccgaccuacggcgugggguaccagcccuaccggguggugguccugagcuucgagcuccugcacgcccccgccacggugugcggccccaagaaguccaccaaccuggugaagaacaagugcgucaacuucaacuucaacggccucaccgggaccggcgugcugaccgagagcaacaagaaguuccugccguuccagcaguucgggcgcgacaucgacgacacgaccgacgccgugcgcgacccccagacccuggagauccucgacaucacccccugcagcuucggcggggucuccgugaucacgccgggcaccaacaccagcaaccagguggcgguccuguaccagggcgugaacugcaccgaggugcccgucgccauccacgccgaccagcugacgcccaccuggcggguguacuccaccgggagcaacguguuccagacccgcgccggcugccucaucggggccgagcacgucaacaacuccuacgagugcgacauccccaucggcgcgggcaucugcgccagcuaccagacgcagaccaacucccaccggcgcgcccggagcguggccucccagagcaucaucgcguacaccaugucccugggggccgagaacagcguggccuacuccaacaacagcaucgccaucccgaucaacuucaccaucuccgucacgaccgagauccugcccgugagcaugaccaagaccagcguggacugcacgauguacaucugcggcgacuccaccgagugcagcaaccuccugcugcaguacggguccuucugcacccagcucaaccgcgcccugaccggcaucgcggucgagcaggacaagaacacgcaggagguguucgcccaggugaagcagaucuacaagaccccgcccaucaaggacuucgggggcuucaacuucagccagauccugcccgaccccuccaagcccagcaagcgguccuucaucgaggaccuccuguucaacaaggucacccuggccgacgccggcuucaucaagcaguacggggacugccucggcgacaucgccgcgcgcgaccugaucugcgcccagaaguucaacgggcugaccgugcugcccccgcuccugacggacgagaugaucgcccaguacaccagcgcccuccuggccggcaccaucaccuccggguggacguucggcgcgggcgccgcccugcagauccccuucgccaugcagauggcguaccgguucaacgggaucggcgugacccagaacguccucuacgagaaccagaagcugaucgccaaccaguucaacagcgccaucgggaagauccaggacucccugagcuccaccgccagcgcccucggcaagcugcaggacguggugaaccagaacgcgcaggcccugaacacccucgucaagcagcuguccagcaacuucggggccaucuccagcgugcugaacgacauccucgcccgccuggacccgcccgaggccgaggugcagaucgaccggcugaucacgggccgccuccagucccugcagaccuacgucacccagcagcugauccgggcggccgagauccgcgccagcgccaaccucgccgcgaccaagaugagcgagugcgugcugggccaguccaagcggguggacuucugcgggaagggcuaccaccugaugagcuucccccaguccgcgccccacggggucguguuccuccacgugaccuacguccccgcccaggagaagaacuucacgaccgcccccgccaucugccacgacggcaaggcccacuucccgcgcgaggggguguucgucagcaacggcacccacugguucgugacccagcggaacuucuacgagccccagaucaucacgacccacaacaccuucguguccggcaacugcgacgucgugaucgggaucgugaacaacaccgucuacgacccccugcagcccgagcuggacagcuucaaggaggagcucgacaaguacuucaagaaccacacguccccggacguggaccugggcgacaucagcgggaucaacgccuccguggucaacauccagaaggagaucgaccgccugaacgagguggccaagaaccucaacgagagccugaucgaccugcaggagcucggcaaguacgagcaguacaucaaguggcccugguacaucuggcugggcuucaucgccgggcugaucgcgaucgugauggucaccaucaugcucugcugcaugaccuccugcugcagcugccugaagggcugcugcuccugcgggagcugcugcaaguucgacgaggacgacuccgagcccgugcugaagggcgugaagcuccacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24648 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_K417N_E484K_N501Y_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaacaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccuacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24649 - RNA, 4026 nt, Artificial Sequence
  SARS-CoV-2/Wuhan/WIV05/2019__EPI_ISL_402128 spike protein mRNA gc (1-1273)(K986P_V987P_K986P_V987P_L18F_D80A_D215G_L242del_A243del_ L244del_R246I_K417N_E484K_N501Y_D614G_A701V)
aggagaaagcuuaccauguucguguuccugguccuccugccccuggugagcucccagugcgugaacuucaccacccgcacgcagcucccgcccgccuacaccaacagcuucacccggggcgucuacuaccccgacaagguguuccgcuccagcgugcugcacuccacccaggaccuguuccuccccuucuucagcaacgucacgugguuccacgccauccacguguccgggaccaacggcaccaagcgguucgcgaacccggugcugcccuucaacgacggggucuacuucgccagcaccgagaaguccaacaucauccgcggcuggaucuucgggacgacccuggacagcaagacccagucccuccugaucgugaacaacgccaccaacguggucaucaaggugugcgaguuccaguucugcaacgaccccuuccugggcguguacuaccacaagaacaacaagagcuggauggaguccgaguuccgggucuacagcuccgccaacaacugcacguucgaguacgugagccagcccuuccucauggaccuggagggcaagcaggggaacuucaagaaccugcgcgaguucguguucaagaacaucgacggcuacuucaagaucuacuccaagcacaccccgaucaaccucguccgggggcugccccagggcuucagcgcccuggagccccucguggaccugcccaucgggaucaacaucacccgcuuccagacccugcacaucuccuaccucacgccgggcgacagcagcuccggcuggaccgcgggggccgccgccuacuacgugggcuaccugcagccccggaccuuccugcucaaguacaacgagaacgggaccaucacggacgcggucgacugcgcccuggacccccugagcgagaccaagugcacccucaaguccuucaccguggagaagggcaucuaccagacgagcaacuuccgcgugcagcccaccgaguccaucguccgguucccgaacaucaccaaccugugccccuucggcgagguguucaacgccacccgcuucgccagcgucuacgccuggaaccggaagcgcaucuccaacugcguggcggacuacagcgugcuguacaacuccgccagcuucuccacguucaagugcuacggggucagccccaccaagcucaacgaccugugcuucaccaacguguacgccgacuccuucgugauccggggcgacgagguccgccagaucgcccccgggcagaccggcaacaucgccgacuacaacuacaagcugccggacgacuucacggggugcgugaucgcguggaacagcaacaaccucgacuccaaggugggcggcaacuacaacuaccuguaccggcuguuccgcaagagcaaccucaagcccuucgagcgggacaucuccaccgagaucuaccaggccgggagcacccccugcaacggcgucaagggguucaacugcuacuucccccugcaguccuacggcuuccagccgaccuacggggugggcuaccagcccuaccgcguggucgugcugagcuucgagcuccugcacgcccccgccacggugugcggccccaagaaguccaccaaccuggucaagaacaagugcgugaacuucaacuucaacgggcucaccggcaccggggugcugaccgagagcaacaagaaguuccugccguuccagcaguucggccgggacaucgccgacacgaccgacgcgguccgcgacccccagacccucgagauccuggacaucacccccugcagcuucgggggcguguccgugaucacgccgggcaccaacaccagcaaccaggucgccgugcuguaccagggggugaacugcaccgagguccccguggccauccacgccgaccagcugacgcccaccuggcgcguguacuccaccggcagcaacgucuuccagacccgggccgggugccucaucggcgcggagcacgugaacaacuccuacgagugcgacauccccaucggcgccgggaucugcgccagcuaccagacgcagaccaacuccccgcgccgggcccgcagcguggcgucccagagcaucaucgccuacaccaugucccugggcgucgagaacagcguggccuacuccaacaacagcaucgccauccccaccaacuucacgaucuccgugaccaccgagauccugcccgucagcaugaccaagacgagcguggacugcaccauguacaucugcggggacuccaccgagugcagcaaccuccugcugcaguacggcuccuucugcacccagcucaaccgggcccugacggggaucgcgguggagcaggacaagaacacccaggaggucuucgcccaggugaagcagaucuacaagacgcccccgaucaaggacuucggcggcuucaacuucagccagauccugcccgaccccuccaagcccagcaagcgcuccuucaucgaggaccuccuguucaacaaggugacccuggccgacgccggguucaucaagcaguacggcgacugccucggggacaucgccgcgcgggaccugaucugcgcccagaaguucaacggccugaccguccucccgccccugcugaccgacgagaugaucgcccaguacaccagcgcccuccuggccgggaccaucacguccggcuggaccuucggcgcgggggccgcccugcagauccccuucgccaugcagauggcguaccgcuucaacggcaucggggugacccagaacgugcucuacgagaaccagaagcugaucgccaaccaguucaacagcgccaucggcaagauccaggacucccugagcuccaccgccagcgcccucgggaagcugcaggacgucgugaaccagaacgcgcaggcccugaacacgcucgugaagcagcuguccagcaacuucggcgccaucuccagcguccugaacgacauccucucccggcuggacccgcccgaggccgaggugcagaucgaccgccugaucaccggccggcuccagagccugcagaccuacgugacccagcagcugauccgcgccgcggagauccgggccagcgccaaccucgccgccaccaagauguccgagugcguccuggggcagagcaagcgcguggacuucugcggcaagggguaccaccugauguccuucccccagagcgcgccccacggcguggucuuccuccacgugacguacguccccgcccaggagaagaacuucaccaccgccccggccaucugccacgacgggaaggcgcacuucccccgggagggcguguucguguccaacggcacccacugguucgucacgcagcgcaacuucuacgagccccagaucaucaccaccgacaacaccuucgugagcgggaacugcgacguggucaucggcaucgugaacaacacgguguacgacccccugcagccggagcuggacuccuucaaggaggagcucgacaaguacuucaagaaccacaccagccccgacgucgaccugggggacaucuccggcaucaacgccagcguggugaacauccagaaggagaucgaccggcugaacgaggucgccaagaaccucaacgagucccugaucgaccugcaggagcucggcaaguacgagcaguacaucaaguggcccugguacaucuggcugggguucaucgccggccugaucgccaucgugauggugaccaucaugcucugcugcaugaccagcugcugcuccugccugaaggggugcugcagcugcggcuccugcugcaaguucgacgaggacgacagcgagccgguccugaagggggugaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24650 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_E484K_D614G)
aggagaaagcuuaccauguucguguuccugguccuccugccccuggugagcucccagugcgugaaccucaccacccgcacgcagcugccgcccgccuacaccaacagcuucacccggggcgucuacuaccccgacaagguguuccgcuccagcgugcugcacuccacccaggaccucuuccugcccuucuucagcaacgucacgugguuccacgccauccacguguccgggaccaacggcaccaagcgguucgacaacccggugcugcccuucaacgacggggucuacuucgcgagcaccgagaaguccaacaucauccgcggcuggaucuucgggacgacccucgacagcaagacccagucccugcugaucgugaacaacgccaccaacguggucaucaaggugugcgaguuccaguucugcaacgaccccuuccucggcguguacuaccacaagaacaacaagagcuggauggaguccgaguuccgggucuacagcuccgccaacaacugcacguucgaguacgugagccagcccuuccugauggaccuggagggcaagcaggggaacuucaagaaccuccgcgaguucguguucaagaacaucgacggcuacuucaagaucuacuccaagcacaccccgaucaaccugguccgggaccugccccagggguucagcgcccucgagccccugguggaccugcccaucggcaucaacaucacccgcuuccagacccuccuggcccugcaccgguccuaccucacgccgggggacagcagcuccggcuggaccgcgggcgccgccgccuacuacgugggguaccugcagccccgcaccuuccugcucaaguacaacgagaacggcaccaucacggacgcggucgacugcgcccuggacccccugagcgagaccaagugcacccucaaguccuucaccguggagaaggggaucuaccagacgagcaacuuccgggugcagcccaccgaguccaucguccgcuucccgaacaucaccaaccugugccccuucggcgagguguucaacgccacccgguucgccagcgucuacgccuggaaccgcaagcggaucuccaacugcguggcggacuacagcgugcuguacaacuccgccagcuucuccacguucaagugcuacggcgucagccccaccaagcucaacgaccugugcuucaccaacguguacgccgacuccuucgugauccgcggggacgagguccggcagaucgcccccggccagaccgggaagaucgccgacuacaacuacaagcugccggacgacuucacgggcugcgugaucgcguggaacagcaacaaccucgacuccaaggucgggggcaacuacaacuaccuguaccgccuguuccgcaagagcaaccucaagcccuucgagcgggacaucuccaccgagaucuaccaggccggcagcacccccugcaacggggugaagggcuucaacugcuacuucccccugcaguccuacggguuccagccgaccaacggcgugggguaccagcccuaccggguggucgugcugagcuucgagcuccugcacgcccccgccacggugugcggccccaagaaguccaccaaccuggucaagaacaagugcgugaacuucaacuucaacggccucaccgggaccggcgugcugaccgagagcaacaagaaguuccugccguuccagcaguucgggcgcgacaucgccgacacgaccgacgcgguccgcgacccccagacccuggagauccucgacaucacccccugcagcuucggcgggguguccgugaucacgccgggcaccaacaccagcaaccaggucgccgugcuguaccagggcgugaacugcaccgagguccccguggccauccacgccgaccagcugacgcccaccuggcggguguacuccaccgggagcaacgucuuccagacccgcgccggcugccucaucggggcggagcacgugaacaacuccuacgagugcgacauccccaucggcgccggcaucugcgccagcuaccagacgcagaccaacuccccgcggcgcgcccggagcguggcgucccagagcaucaucgccuacaccaugucccugggggccgagaacagcgucgccuacuccaacaacagcaucgccauccccaccaacuucacgaucuccgugaccaccgagauccugcccgugagcaugaccaagacgagcgucgacugcaccauguacaucugcggcgacuccaccgagugcagcaaccuccugcugcaguacggguccuucugcacccagcucaaccgcgcgcugacgggcaucgccguggagcaggacaagaacacccaggagguguucgcccaggucaagcagaucuacaagacgcccccgaucaaggacuucgggggcuucaacuucagccagauccugcccgaccccuccaagcccagcaagcgguccuucaucgaggaccuccuguucaacaaggugacccuggccgacgccggcuucaucaagcaguacggggacugccucggcgacaucgcggcccgcgaccugaucugcgcccagaaguucaacgggcugaccgugcucccgccccugcugaccgacgagaugaucgcccaguacaccagcgcccuccuggcgggcaccaucacguccggguggaccuucggcgccggcgccgcccugcagauccccuucgcgaugcagauggccuaccgguucaacgggaucggcgucacccagaacgugcucuacgagaaccagaagcugaucgccaaccaguucaacagcgccaucgggaagauccaggacucccugagcuccaccgccagcgcgcucggcaagcugcaggacguggucaaccagaacgcccaggcccugaacacgcucgugaagcagcuguccagcaacuucggggccaucuccagcgugcugaacgacauccucucccgccuggacccgcccgaggccgagguccagaucgaccggcugaucaccggccgccuccagagccugcagaccuacgugacccagcagcugauccgggcggccgagauccgcgccagcgccaaccucgccgcgaccaagauguccgagugcgugcugggccagagcaagcgggucgacuucugcgggaagggcuaccaccugauguccuucccccagagcgcgccccacggggugguguuccuccacgucacguacgugcccgcccaggagaagaacuucaccaccgccccggccaucugccacgacggcaaggcccacuucccccgcgagggggucuucguguccaacggcacccacugguucgugacgcagcggaacuucuacgagccccagaucaucaccaccgacaacaccuucgucagcggcaacugcgacguggugaucgggaucgucaacaacacgguguacgacccccugcagccggagcuggacuccuucaaggaggagcucgacaaguacuucaagaaccacaccagccccgacguggaccugggcgacaucuccgggaucaacgccagcgucgugaacauccagaaggagaucgaccgccugaacgagguggccaagaaccucaacgagucccugaucgaccugcaggagcucggcaaguacgagcaguacaucaaguggcccugguacaucuggcugggcuucaucgccgggcugaucgcgaucgucauggugaccaucaugcucugcugcaugaccagcugcugcuccugccugaagggcugcugcagcugcggguccugcugcaaguucgacgaggacgacagcgagccggugcugaagggcgucaagcuccacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24651 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_L18F_T20N_P26S_D138Y_R190S_K417T _E484K_N501Y_D614G_H655Y_T1027I)
aggagaaagcuuaccauguucguguuccugguccuccugccccuggugagcucccagugcgugaacuucaccaaccgcacccagcucccgagcgccuacacgaacuccuucacccggggcgucuacuaccccgacaagguguuccgcagcuccgugcugcacagcacccaggaccuguuccuccccuucuucuccaacgucaccugguuccacgccauccacgugagcgggacgaacggcaccaagcgguucgacaaccccgugcugccguucaacgacggggucuacuucgcguccaccgagaaguccaacaucauccgcggcuggaucuucgggaccacgcuggacuccaagacccagagccuccugaucgugaacaacgccaccaacguggucaucaaggugugcgaguuccaguucugcaacuaccccuuccugggcguguacuaccacaagaacaacaaguccuggauggagagcgaguuccgggucuacuccagcgccaacaacugcaccuucgaguacgugucccagcccuuccucauggaccuggagggcaagcaggggaacuucaagaaccugagcgaguucguguucaagaacaucgacggcuacuucaagaucuacuccaagcacacgcccaucaaccucguccgcgaccugccgcagggguucagcgcccuggagccccucguggaccugcccaucggcaucaacaucacccgguuccagacccugcucgcccugcaccgcagcuaccugacccccggggacuccagcuccggcuggacggcgggcgccgccgccuacuacgugggguaccuccagccgcggaccuuccugcugaaguacaacgagaacggcaccaucaccgacgcggucgacugcgcccucgacccccugagcgagacgaagugcacccugaaguccuucaccguggagaaggggaucuaccagaccagcaacuuccgcgugcagcccacggaguccaucguccgguuccccaacaucaccaaccucugcccguucggcgagguguucaacgccacccgcuucgccagcgucuacgccuggaaccggaagcgcaucuccaacugcguggcggacuacagcgugcuguacaacuccgccagcuucuccaccuucaagugcuacggcgucagccccacgaagcugaacgaccucugcuucaccaacguguacgccgacuccuucgugauccgcggggacgagguccggcagaucgcccccggccagaccgggaccaucgccgacuacaacuacaagcugcccgacgacuucacgggcugcgugaucgcguggaacagcaacaaccuggacuccaaggucgggggcaacuacaacuaccucuaccggcuguuccgcaagagcaaccugaagccguucgagcgggacaucuccaccgagaucuaccaggccggcagcacccccugcaacggggugaagggcuucaacugcuacuucccccuccagagcuacggguuccagcccaccuacggcgugggguaccagccguaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugcccuuccagcaguucgggcgggacaucgccgacacgaccgacgcgguccgcgacccgcagacccuggagauccuggacaucacccccugcagcuucggcgggguguccgugaucacgcccggcaccaacaccagcaaccaggucgccgugcucuaccagggcgugaacugcaccgaggucccgguggccauccacgccgaccagcugacgcccaccuggcgcguguacuccaccgggagcaacgucuuccagacccgggccggcugccugaucggggcggaguacgugaacaacuccuacgagugcgacauccccaucggcgccggcaucugcgccagcuaccagacgcagaccaacagcccccgccgggcccgcagcguggcgucccagagcaucaucgccuacaccaugucccucggggccgagaacagcgucgccuacuccaacaacagcaucgccaucccgaccaacuucacgaucagcgugaccaccgagauccugcccguguccaugaccaagacgagcgucgacugcaccauguacaucugcggcgacuccaccgagugcagcaaccugcuccugcaguacggguccuucugcacccagcugaaccgggcgcucacgggcaucgccguggagcaggacaagaacacccaggagguguucgcccaggucaagcagaucuacaagaccccgcccaucaaggacuucgggggcuucaacuucagccagauccugcccgaccccuccaagcccagcaagcgcuccuucaucgaggaccuccuguucaacaaggugacccuggccgacgccggcuucaucaagcaguacggggacugccugggcgacaucgcggcccgggaccucaucugcgcccagaaguucaacgggcugacggugcugcccccgcuccugaccgacgagaugaucgcccaguacaccagcgcccugcucgcgggcaccaucacguccggguggaccuucggcgccggcgccgcccugcagauccccuucgcgaugcagauggccuaccgcuucaacgggaucggcgucacccagaacgugcuguacgagaaccagaagcucaucgccaaccaguucaacagcgccaucgggaagauccaggacucccugagcuccaccgccagcgcgcugggcaagcuccaggacguggucaaccagaacgcccaggcccugaacacgcuggugaagcagcucuccagcaacuucggggccaucuccagcgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaucaagauguccgagugcgugcucggccagagcaagcgcgucgacuucugcgggaagggcuaccaccugauguccuucccccagagcgcgccccacggggugguguuccugcacgucaccuacgugcccgcccaggagaagaacuucacgaccgcccccgccaucugccacgacggcaaggcccacuucccgcgggagggggucuucguguccaacggcacccacugguucgugacccagcgcaacuucuacgagccccagaucaucacgaccgacaacaccuucgucagcggcaacugcgacguggugaucgggaucgucaacaacaccguguacgacccccuccagcccgagcuggacuccuucaaggaggagcuggacaaguacuucaagaaccacacgagcccggacguggaccucggcgacaucuccgggaucaacgccagcgucgugaacauccagaaggagaucgaccggcugaacgagguggccaagaaccugaacgagucccucaucgaccugcaggagcugggcaaguacgagcaguacaucaaguggcccugguacaucuggcucggcuucaucgccgggcugaucgcgaucgucauggugaccaucaugcugugcugcaugaccagcugcugcuccugccucaagggcugcugcagcugcggguccugcugcaaguucgacgaggacgacagcgagcccgugcugaagggcgucaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24652 - RNA, 4035 nt, Artificial Sequence
  SARS-CoV-2/Wuhan/WIV05/2019__EPI_ISL_402128 spike protein mRNA gc (1-1273)(K986P_V987P_K986P_V987P_S13I_W152C_L452R_D614G)
aggagaaagcuuaccauguucguguuccugguccuccugccccuggugagcauccagugcgugaaccucaccacccgcacgcagcugccgcccgccuacaccaacuccuucacccggggcgucuacuaccccgacaagguguuccgcagcuccgugcugcacagcacccaggaccucuuccugcccuucuucuccaacgucacgugguuccacgccauccacgugagcgggaccaacggcaccaagcgguucgacaacccggugcugcccuucaacgacggggucuacuucgcguccaccgagaaguccaacaucauccgcggcuggaucuucgggacgacccucgacagcaagacccagagccugcugaucgugaacaacgccaccaacguggucaucaaggugugcgaguuccaguucugcaacgaccccuuccucggcguguacuaccacaagaacaacaaguccugcauggagagcgaguuccgggucuacuccagcgccaacaacugcacguucgaguacgugucccagcccuuccugauggaccuggagggcaagcaggggaacuucaagaaccuccgcgaguucguguucaagaacaucgacggcuacuucaagaucuacagcaagcacaccccgaucaaccugguccgggaccugccccagggguucuccgcccucgagccccugguggaccugcccaucggcaucaacaucacccgcuuccagacccuccuggcccugcaccggagcuaccucacgccgggggacuccagcagcggcuggaccgcgggcgccgccgccuacuacgugggguaccugcagccccgcaccuuccugcucaaguacaacgagaacggcaccaucacggacgcggucgacugcgcccuggacccccuguccgagaccaagugcacccucaagagcuucaccguggagaaggggaucuaccagacguccaacuuccgggugcagcccaccgagagcaucguccgcuucccgaacaucaccaaccugugccccuucggcgagguguucaacgccacccgguucgccuccgucuacgccuggaaccgcaagcggaucagcaacugcguggcggacuacuccgugcuguacaacagcgccuccuucagcacguucaagugcuacggcgucucccccaccaagcucaacgaccugugcuucaccaacguguacgccgacagcuucgugauccgcggggacgagguccggcagaucgcccccggccagaccgggaagaucgccgacuacaacuacaagcugccggacgacuucacgggcugcgugaucgcguggaacuccaacaaccucgacagcaaggucgggggcaacuacaacuaccgcuaccggcuguuccgcaaguccaaccugaagcccuucgagcgggacaucagcaccgagaucuaccaggccggcuccacccccugcaacgggguggagggcuucaacugcuacuucccccuccagagcuacggguuccagccgaccaacggcgugggguaccagcccuaccgcguggucgugcuguccuucgagcugcuccacgcccccgccacggugugcggccccaagaaguccaccaaccuggucaagaacaagugcgugaacuucaacuucaacggccugaccgggaccggcgugcucaccgagagcaacaagaaguuccugccguuccagcaguucgggcgcgacaucgccgacacgaccgacgcgguccgggacccccagacccuggagauccuggacaucacccccugcagcuucggcggggugagcgugaucacgccgggcaccaacaccuccaaccaggucgccgugcucuaccagggcgugaacugcaccgagguccccguggccauccacgccgaccagcugacgcccaccuggcgcguguacagcaccggguccaacgucuuccagacccgggccggcugccugaucggggcggagcacgugaacaacagcuacgagugcgacauccccaucggcgccggcaucugcgccuccuaccagacgcagaccaacagcccgcgccgggcccgcuccguggcgagccaguccaucaucgccuacaccaugagccucggggccgagaacuccgucgccuacagcaacaacuccaucgccauccccaccaacuucacgaucagcgugaccaccgagauccugcccguguccaugaccaagacgagcgucgacugcaccauguacaucugcggcgacagcaccgagugcuccaaccugcuccugcaguacgggagcuucugcacccagcugaaccgggcgcucacgggcaucgccguggagcaggacaagaacacccaggagguguucgcccaggucaagcagaucuacaagacgcccccgaucaaggacuucgggggcuucaacuucucccagauccugcccgaccccagcaagcccuccaagcgcagcuucaucgaggaccuccuguucaacaaggugacccuggccgacgccggcuucaucaagcaguacggggacugccugggcgacaucgcggcccgggaccucaucugcgcccagaaguucaacgggcugaccgugcugccgccccuccugaccgacgagaugaucgcccaguacaccuccgcccugcucgcgggcaccaucacgagcggguggaccuucggcgccggcgccgcccugcagauccccuucgcgaugcagauggccuaccgcuucaacgggaucggcgucacccagaacgugcuguacgagaaccagaagcucaucgccaaccaguucaacuccgccaucgggaagauccaggacagccuguccagcaccgccuccgcgcugggcaagcuccaggacguggucaaccagaacgcccaggcccugaacacgcuggugaagcagcucagcuccaacuucggggccaucagcuccgugcugaacgacauccugagccggcucgacccgcccgaggccgagguccagaucgaccgccugaucaccggccggcugcagucccuccagaccuacgugacccagcagcugauccgcgcggccgagauccgggccagcgccaaccuggccgcgaccaagaugagcgagugcgugcucggccaguccaagcgcgucgacuucugcgggaagggcuaccaccugaugagcuucccccaguccgcgccccacggggugguguuccugcacgucacguacgugcccgcccaggagaagaacuucaccaccgccccggccaucugccacgacggcaaggcccacuucccccgggagggggucuucgugagcaacggcacccacugguucgugacgcagcgcaacuucuacgagccccagaucaucaccaccgacaacaccuucgucuccggcaacugcgacguggugaucgggaucgucaacaacacgguguacgacccccuccagccggagcuggacagcuucaaggaggagcuggacaaguacuucaagaaccacaccucccccgacguggaccucggcgacaucagcgggaucaacgccuccgucgugaacauccagaaggagaucgaccggcugaacgagguggccaagaaccugaacgagagccucaucgaccugcaggagcugggcaaguacgagcaguacaucaaguggcccugguacaucuggcucggcuucaucgccgggcugaucgcgaucgucauggugaccaucaugcugugcugcaugaccuccugcugcagcugccucaagggcugcugcuccugcgggagcugcugcaaguucgacgaggacgacuccgagccggugcugaagggcgucaagcugcacuacacgugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24653 - RNA, 4035 nt, Artificial Sequence
  SARS-CoV-2/Wuhan/WIV05/2019__EPI_ISL_402128 spike protein mRNA gc (1-1273)(K986P_V987P)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccaggacgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24654 - RNA, 4035 nt, Artificial Sequence
  SARS-CoV-2/Wuhan/WIV05/2019__EPI_ISL_402128 spike protein mRNA gc (1-1273)(K986P_V987P_ D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24655 - RNA, 4035 nt, Artificial Sequence
  SARS-CoV-2/Wuhan/WIV05/2019__EPI_ISL_402128 spike protein mRNA gc (1-1273)(K986P_V987P_A222V_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagugcuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24656 - RNA, 4035 nt, Artificial Sequence
  SARS-CoV-2/Wuhan/WIV05/2019__EPI_ISL_402128 spike protein mRNA gc (1-1273)(K986P_V987P_N439K_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaagaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24657 - RNA, 4035 nt, Artificial Sequence
  SARS-CoV-2/Wuhan/WIV05/2019__EPI_ISL_402128 spike protein mRNA gc (1-1273)(K986P_V987P_S477N_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcaacaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24658 - RNA, 4035 nt, Artificial Sequence
  SARS-CoV-2/Wuhan/WIV05/2019__EPI_ISL_402128 spike protein mRNA gc (1-1273)(K986P_V987P_N501Y_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccuacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24659 - RNA, 4029 nt, Artificial Sequence
  SARS-CoV-2/Wuhan/WIV05/2019__EPI_ISL_402128 spike protein mRNA gc (1-1273)(K986P_V987P_H69del_V70del_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccaucagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24660 - RNA, 4035 nt, Artificial Sequence
  SARS-CoV-2/Wuhan/WIV05/2019__EPI_ISL_402128 spike protein mRNA gc (1-1273)(K986P_V987P_Y453F_D614G)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguuccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcaucaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 24661 - RNA, 4035 nt, Artificial Sequence
  SARS-CoV-2/Wuhan/WIV05/2019__EPI_ISL_402128 spike protein mRNA gc (1-1273)(K986P_V987P_D614G_I692V)
aggagaaagcuuaccauguucguguuccuggugcugcugccccuggugagcagccagugcgugaaccugaccacccggacccagcugccaccagccuacaccaacagcuucacccggggcgucuacuaccccgacaagguguuccggagcagcguccugcacagcacccaggaccuguuccugcccuucuucagcaacgugaccugguuccacgccauccacgugagcggcaccaacggcaccaagcgguucgacaaccccgugcugcccuucaacgacggcguguacuucgccagcaccgagaagagcaacaucauccggggcuggaucuucggcaccacccuggacagcaagacccagagccugcugaucgugaauaacgccaccaacguggugaucaaggugugcgaguuccaguucugcaacgaccccuuccugggcguguacuaccacaagaacaacaagagcuggauggagagcgaguuccggguguacagcagcgccaacaacugcaccuucgaguacgugagccagcccuuccugauggaccuggagggcaagcagggcaacuucaagaaccugcgggaguucguguucaagaacaucgacggcuacuucaagaucuacagcaagcacaccccaaucaaccuggugcgggaucugccccagggcuucucagcccuggagccccugguggaccugcccaucggcaucaacaucacccgguuccagacccugcuggcccugcaccggagcuaccugaccccaggcgacagcagcagcggguggacagcaggcgcggcugcuuacuacgugggcuaccugcagccccggaccuuccugcugaaguacaacgagaacggcaccaucaccgacgccguggacugcgcccuggacccucugagcgagaccaagugcacccugaagagcuucaccguggagaagggcaucuaccagaccagcaacuuccgggugcagcccaccgagagcaucgugcgguuccccaacaucaccaaccugugccccuucggcgagguguucaacgccacccgguucgccagcguguacgccuggaaccggaagcggaucagcaacugcguggccgacuacagcgugcuguacaacagcgccagcuucagcaccuucaagugcuacggcgugagccccaccaagcugaacgaccugugcuucaccaacguguacgccgacagcuucgugauccguggcgacgaggugcggcagaucgcacccggccagacaggcaagaucgccgacuacaacuacaagcugcccgacgacuucaccggcugcgugaucgccuggaacagcaacaaccucgacagcaaggugggcggcaacuacaacuaccuguaccggcuguuccggaagagcaaccugaagcccuucgagcgggacaucagcaccgagaucuaccaagccggcuccaccccuugcaacggcguggagggcuucaacugcuacuucccucugcagagcuacggcuuccagcccaccaacggcgugggcuaccagcccuaccgggugguggugcugagcuucgagcugcugcacgccccagccaccguguguggccccaagaagagcaccaaccuggugaagaacaagugcgugaacuucaacuucaacggccuuaccggcaccggcgugcugaccgagagcaacaagaaauuccugcccuuucagcaguucggccgggacaucgccgacaccaccgacgcugugcgggauccccagacccuggagauccuggacaucaccccuugcagcuucggcggcgugagcgugaucaccccaggcaccaacaccagcaaccagguggccgugcuguaccagggcgugaacugcaccgaggugcccguggccauccacgccgaccagcugacacccaccuggcgggucuacagcaccggcagcaacguguuccagacccgggccgguugccugaucggcgccgagcacgugaacaacagcuacgagugcgacauccccaucggcgccggcaucugugccagcuaccagacccagaccaauucaccccggagggcaaggagcguggccagccagagcgugaucgccuacaccaugagccugggcgccgagaacagcguggccuacagcaacaacagcaucgccauccccaccaacuucaccaucagcgugaccaccgagauucugcccgugagcaugaccaagaccagcguggacugcaccauguacaucugcggcgacagcaccgagugcagcaaccugcugcugcaguacggcagcuucugcacccagcugaaccgggcccugaccggcaucgccguggagcaggacaagaacacccaggagguguucgcccaggugaagcagaucuacaagaccccucccaucaaggacuucggcggcuucaacuucagccagauccugcccgaccccagcaagcccagcaagcggagcuucaucgaggaccugcuguucaacaaggugacccuagccgacgccggcuucaucaagcaguacggcgacugccucggcgacauagccgcccgggaccugaucugcgcccagaaguucaacggccugaccgugcugccuccccugcugaccgacgagaugaucgcccaguacaccagcgcccuguuagccggaaccaucaccagcggcuggacuuucggcgcuggagccgcucugcagauccccuucgccaugcagauggccuaccgguucaacggcaucggcgugacccagaacgugcuguacgagaaccagaagcugaucgccaaccaguucaacagcgccaucggcaagauccaggacagccugagcagcaccgcuagcgcccugggcaagcugcaggacguggugaaccagaacgcccaggcccugaacacccuggugaagcagcugagcagcaacuucggcgccaucagcagcgugcugaacgacauccugagccggcuggacccucccgaggccgaggugcagaucgaccggcugaucacuggccggcugcagagccugcagaccuacgugacccagcagcugauccgggccgccgagauucgggccagcgccaaccuggccgccaccaagaugagcgagugcgugcugggccagagcaagcggguggacuucugcggcaagggcuaccaccugaugagcuuuccccagagcgcaccccacggagugguguuccugcacgugaccuacgugcccgcccaggagaagaacuucaccaccgccccagccaucugccacgacggcaaggcccacuuuccccgggagggcguguucgugagcaacggcacccacugguucgugacccagcggaacuucuacgagccccagaucaucaccaccgacaacaccuucgugagcggcaacugcgacguggugaucggcaucgugaacaacaccguguacgauccccugcagcccgagcuggacagcuucaaggaggagcuggacaaguacuucaagaaucacaccagccccgacguggaccugggcgacaucagcggcaucaacgccagcguggugaacauccagaaggagaucgaucggcugaacgagguggccaagaaccugaacgagagccugaucgaccugcaggagcugggcaaguacgagcaguacaucaaguggcccugguacaucuggcugggcuucaucgccggccugaucgccaucgugauggugaccaucaugcugugcugcaugaccagcugcugcagcugccugaagggcuguugcagcugcggcagcugcugcaaguucgacgaggacgacagcgagcccgugcugaagggcgugaagcugcacuacaccugaggacuaguuauaagacugacuagcccgaugggccucccaacgggcccuccuccccuccuugcaccgagagaucucaaaggcucuuuucagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
